(12) United States Patent
Fuenzalida et al.

(10) Patent No.: US 11,805,774 B2
(45) Date of Patent: *Nov. 7, 2023

(54) SEED TREATMENT METHODS AND COMPOSITIONS FOR IMPROVING PLANT TRAITS AND YIELD

(71) Applicant: ANDES AG, INC., Emeryville, CA (US)

(72) Inventors: Gonzalo Fuenzalida, Emeryville, CA (US); Tania Timmermann, Emeryville, CA (US); Roque Giordano, Santiago (CL); Veronica Morgante, Santiago (CL)

(73) Assignee: ANDES AG, INC., Emeryville, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/520,587

(22) Filed: Nov. 5, 2021

(65) Prior Publication Data
US 2022/0053770 A1 Feb. 24, 2022

Related U.S. Application Data

(63) Continuation of application No. 17/503,196, filed on Oct. 15, 2021, which is a continuation of application No. PCT/US2020/028569, filed on Apr. 16, 2020.
(Continued)

(51) Int. Cl.
*A01N 63/20* (2020.01)
*A01N 63/27* (2020.01)
(Continued)

(52) U.S. Cl.
CPC ............ *A01N 63/27* (2020.01); *A01C 1/06* (2013.01); *A01H 3/00* (2013.01); *A01N 63/20* (2020.01);
(Continued)

(58) Field of Classification Search
CPC ......... A01N 63/20; A01N 63/22; C12N 1/20; A01C 1/06; Y10S 47/09; A01H 3/00; A01H 5/10
See application file for complete search history.

(56) References Cited

U.S. PATENT DOCUMENTS 2,932,128 A 4/1960 Porter et al.
2,935,128 A 5/1960 William
(Continued)

FOREIGN PATENT DOCUMENTS

WO WO-9111907 A1 8/1991
WO WO-2015035099 A1 3/2015
(Continued)

OTHER PUBLICATIONS

Hardoim et al., PLoS one, 2012, 7:e30438, pp. 1-12 (Year: 2012).*
(Continued)

*Primary Examiner* — Allison M Fox
*Assistant Examiner* — Qing Xu
(74) *Attorney, Agent, or Firm* — Wilson Sonsini Goodrich & Rosati

(57) ABSTRACT

Described herein are methods and compositions for improving plant growth and other properties. The methods and compositions utilize bacteria and bacterial exudates incorporated into plant seeds for improvement of plant growth and other properties.

15 Claims, 22 Drawing Sheets

Specification includes a Sequence Listing.

Related U.S. Application Data

(60) Provisional application No. 62/835,281, filed on Apr. 17, 2019.

(51) Int. Cl.
  *C12N 1/20* (2006.01)
  *A01N 63/22* (2020.01)
  *A01C 1/06* (2006.01)
  *C05F 11/08* (2006.01)
  *A01H 3/00* (2006.01)
  *C05G 3/60* (2020.01)

(52) U.S. Cl.
  CPC .............. *A01N 63/22* (2020.01); *C05F 11/08* (2013.01); *C12N 1/20* (2013.01); *C05G 3/60* (2020.02)

(56) References Cited

U.S. PATENT DOCUMENTS

| | | | |
|---|---|---|---|
| 5,113,619 | A | 5/1992 | Leps et al. |
| 5,415,672 | A * | 5/1995 | Fahey .................... C12N 1/00 504/117 |
| 2010/0154299 | A1 | 6/2010 | Kobayashi et al. |
| 2015/0289515 | A1 | 10/2015 | Ryu et al. |
| 2016/0330976 | A1 | 11/2016 | Mitter et al. |
| 2016/0338360 | A1 | 11/2016 | Mitter et al. |
| 2017/0223967 | A1 | 8/2017 | Mitter et al. |
| 2018/0020677 | A1 | 1/2018 | Ambrose et al. |
| 2018/0064116 | A1 | 3/2018 | Bullis et al. |
| 2018/0098483 | A1 | 4/2018 | Fabbri et al. |
| 2018/0132486 | A1 | 5/2018 | Mitter et al. |

FOREIGN PATENT DOCUMENTS

| | | |
|---|---|---|
| WO | WO-2015100431 A2 | 7/2015 |
| WO | WO-2015100432 A2 | 7/2015 |
| WO | WO-2016130586 A2 | 8/2016 |
| WO | WO-2020214843 A1 | 10/2020 |

OTHER PUBLICATIONS

Johnson et al., Fungal Diversity, 2013, 60:171-188 (Year: 2013).*
The printout of rice seed weight, downloaded on Apr. 14, 2022 from https://www.reference.com/world-view/much-single-grain-rice-weigh-c39a20469d3fe660 (Year: 2022).*
Kang et al., Journal of Applied Botany and Food Quality, 2019, 92:172-178. (Year: 2019).*
Hashem et al., Saudi Journal of Biological Sciences, 2019, 26:1291-1297 (Year: 2019).*
Reader et al., 2017, ECHO Development Notes, No. 136, pp. 1-6 (Year: 2017).*
Liu et al., abstract, Mycologia, 2017, 109(5): 691-700 (Year: 2017).*
Ruiza et al., Journal of Microbiology, 2011, 49(6): 902-912 (Year: 2011).*
Robinson et al., Sci. Rep. 2016, 6:25581, pp. 1-9 (Year: 2016).*
Wikipedia printout of Paenibacillus, downloaded on Feb. 24, 2023, from https://en.wikipedia.org/wiki/Paenibacillus (Year: 2023).*
Ali et al.: Pseudomonas sp. strain AKM-P6 enhances tolerance of sorghum seedlings to elevated temperatures. Biol. Fertil. Soils. 46:45-55 doi:10.1007/s00374-009-0404-9 (2009).
Ali et al.: Effect of inoculation with a thermotolerant plant growth promoting Pseudomonas putida strain AKMP7 on growth of wheat (*Triticum* spp.) under heat stress. J. Plant Interact. 6(4):239-246 doi:10.1080/17429145.2010.545147 (2011).
Ashraf et al.: Pre-Sowing Seed Treatment—A Shotgun Approach to Improve Germination, Plant Growth, and Crop Yield Under Saline and Non-Saline Conditions. Adv. Agron. 88:223-271 doi:10.1016/S0065-2113(05)88006-X (2005).

Badri et al.: Application of natural blends of phytochemicals derived from the root exudates of *Arabidopsis* to the soil reveal that phenolic-related compounds predominantly modulate the soil microbiome. J. Biol. Chem. 288(7):4502-4512 doi:10.1074/jbc.M112.433300 (2013).
Badri et al.: Regulation and function of root exudates. Plant Cell Environ. 32(6):666-681 doi:10.1111/j.1365-3040.2009.01926.x (2009).
Baez-Rogelio et al.: Next generation of microbial inoculants for agriculture and bioremediation. Microb Biotechnol. 10(1):19-21 doi:10.1111/1751-7915.12448 (2017).
Bais et al.: The role of root exudates in rhizosphere interactions with plants and other organisms. Annu Rev Plant Biol. 57:233-266 doi:10.1146/annurev.arplant.57.032905.105159 (2006).
Barea at el.: Mycorrhizosphere interactions to improve plant fitness and soil quality. Antonie Van Leeuwenhoek 81:343-351 doi:10.1023/A:1020588701325 (2002).
Barea: Future challenges and perspectives for applying microbial biotechnology in sustainable agriculture based on a better understanding of plant-microbiome interactions. J. Soil Sci. Plant Nutr. 15(2):261-282 doi:10.4067/S0718-95162015005000021 (2015).
Bashan et al.: Advances in plant growth-promoting bacterial inoculant technology: Formulations and practical perspectives (1998-2013). Plant and Soil 378(1-2):1-33 doi:10.1007/s11104-013-1956-x (2014).
Bashan: Inoculants of plant growth-promoting bacteria for use in agriculture. Biotechnol Adv. 16(4):729-770 doi:10.1016/S0734-9750(98)00003-2 (1998).
Bennett et al.: Beneficial microorganism survival on seed, roots and in rhizosphere soil following application to seed during drum priming. Biol. Control. 44(3):349-361 doi:10.1016/j.biocontrol.2007.11.005 (2008).
Bennett et al.: Dual application of beneficial microorganisms to seed during drum priming. Appl. Soil Ecol. 38(1):83-89 doi:10.1016/j.apsoil.2007.08.001 (2008).
Bennett et al.: Performance of carrot and onion seed primed with beneficial microorganisms in glasshouse and field trials. Biol. Control 51(3):417-426 doi:10.1016/j.biocontrol.2009.08.001 (2009).
Beringer et al.: Maintenance and assessment of cell viability in formulation of non-sporulating bacterial inoculants. Microb. Biotechnol. 11(2):277-301 doi:10.1111/1751-7915.12880 (2018).
Bringezu et al.: Assessing global resource use: A systems approach to resource efficiency and pollution reduction. UN Environment, International Resource Panel [1-104] (2017).
Calabi-Floody et al: Smart Fertilizers as a Strategy for Sustainable Agriculture. Adv. Agron. 147:119-157 doi:10.1016/bs.agron.2017.10.003 (2018).
Callan et al.: Bio-priming Seed Treatment for Biological Control of Pythium ultimum Preemergence Damping-off in sh2 Sweet Corn. Plant Dis. 74(5):368-372 doi:10.1094/PD-74-0368 (1990).
Callan et al.: Field performance of sweet corn seed bio-primed and coated with Pseudomonas fluorescens AB254. Hortscience 26(9):1163-1165 (1991).
Cassan et al.: *Azospirillum* sp. in current agriculture: From the laboratory to the field. Soil Biol. Biochem. 103:117-130 doi:10.1007/978-3-319-76132-9_10 (2016).
Chakraborty et al.: Plant Growth Promotion and Amelioration of Salinity Stress in Crop Plants by a Salt-Tolerant Bacterium. Recent Res Sci Technol. 3(11):61-70 (2011).
Chamam et al.: Plant secondary metabolite profiling evidences strain-dependent effect in the Azospirillum-Oryza sativa association. Phytochemistry 87:65-77 doi:10.1016/j.phytochem.2012.11.009 (2013).
Chaparro et al.: Root Exudation of Phytochemicals in *Arabidopsis* Follows Specific Patterns That Are Developmentally Programmed and Correlate with Soil Microbial Functions. PLoS One. 8(2):e55731:1-10 doi:10.1371/journal.pone.0055731 (2013).
Co-pending U.S. Appl. No. 17/503,196, inventors Gonzalo Fuenzalida; et al., filed on Oct. 15, 2021.
Date: Advances in inoculant technology: A brief review. Aust. J. Exp. Agric. 41(3)321-325 doi:10.1071/EA00006 (2001).
De Freitas et al.: Growth promotion of winter wheat by fluorescent pseudomonads under field conditions. Soil Biology & Biochemistry 24(11):1137-1146 (1992).

(56) References Cited

OTHER PUBLICATIONS

Dimpka et al.: Plant-rhizobacteria interactions alleviate abiotic stress conditions. Plant, Cell Environ. 32:1682-1694 doi:10.1111/j.1365-3040.2009.02028.x (2009).
El-Mougy et al.: Long-term activity of bio-priming seed treatment for biological control of faba bean root rot pathogens. Australas. Plant Pathol. 37(5):464-471 doi:10.1071/AP08043 (2008).
Fasciglione et al.: Azospirillum inoculation effects on growth, product quality and storage life of lettuce plants grown under salt stress. Sci. Hortic. 195(12):154-162 doi:10.1016/j.scienta.2015.09.015 (2015).
Global Harvest Initiative: GAP 2017 Global Agricultural Productivity Report: A World of Productive Sustainable Agriculture. URL:http://www.globalharvestinitiative.org/gap-report-gap-index/2017-gap-report/ [1-72] (2017).
Heydecker et al.: Accelerated Germination by Osmotic Seed Treatment. Nature 246:42-44 URL:https://doi.org/10.1038/246042a0 (1973).
Hill et al.: Primed Lettuce Seeds Exhibit Increased Sensitivity to Moisture Content During Controlled Deterioration. HortScience 42(6):1436-1439 URL:https://doi.org/10.21273/HORTSCI.42.6.1436 (2007).
Kaur et al.: Mitigating the impact of climate change by use of microbial inoculants. Pharma Innov. J. 7(1):279-288 (2018).
Kloepper et al.: Induced Systemic Resistance and Promotion of Plant Growth by *Bacillus* spp. Phytopathology 94(11)1259-1266 doi:10.1094/PHYTO.2004.94.11.1259 (2004).
Kumar: Phosphate solubilizing bacteria in agriculture biotechnology: Diversity, mechanism and their role in plant growth and crop yield. IJAR 4(4):116-124 DOI:10.21474/IJAR01/111 (2016).
Ledger et al.: Aromatic compounds degradation plays a role in colonization of *Arabidopsis thaliana* and Acacia caven by Cupriavidus pinatubonensis JMP134. Antonie van Leeuwenhoek, Int. J. Gen. Mol. Microbiol. 101:713-723 doi:10.1007/s10482-011-9685-8 (2012).
Ledger et al.: Volatile-mediated effects predominate in Paraburkholderia phytofirmans growth promotion and salt stress tolerance of *Arabidopsis thaliana*. Front. Microbiol. 7:1838 doi:10.3389/fmicb.2016.01838 [1-18] (2016).
Leggett et al.: Maize yield response to a phosphorus-solubilizing microbial inoculant in field trials. J. Agric. Sci. 153(8):1464-1478 doi:10.1017/S0021859614001166 (2015).
Leggett et al.: Soybean response to inoculation with Bradyrhizobium japonicum in the United States and Argentina. Agron. J. 109(3):1031-1038 doi:10.2134/agronj2016.04.0214 (2017).
Lugtenberg et al.: Plant-growth-promoting Rhizobacteria. Annu. Rev. Microbiol. 63:541-556 doi:10.1146/annurev.micro.62.081307.162918 (2009).
Mahakham et al.: Nanopriming technology for enhancing germination and starch metabolism of aged rice seeds using phytosynthesized silver nanoparticles. Scientific Reports 7(1):8263 DOI:10.1038/s41598-017-08669-5 [1-21] (2017).
Mahmood et al.: Seed biopriming with plant growth promoting rhizobacteria: a review. FEMS Microbiol. Ecol. 92:1-14 doi:10.1093/femsec/fiw112 (2016).
Manoli et al.: Evaluation of candidate reference genes for qPCR in maize. J Plant Physiol. 169(8):807-815 doi:10.1016/j.jplph.2012.01.019 (2012).
Marulanda et al.: Regulation of plasma membrane aquaporins by inoculation with a Bacillus megaterium strain in maize (*Zea mays* L.) plants under unstressed and salt-stressed conditions. Planta 232(2):533-543 doi:10.1007/s00425-010-1196-8 (2010).
McDonald: Seed Deterioration: Physiology repair and assessment. Seed Sci. Technol. 27(1):177-237 (1999).
McQuilken et al.: Application of Microorganisms to Seeds. In: Burges H.D. (eds) Formulation of Microbial Biopesticides. Springer, Dordrecht, pp. 255-285. URL:https://doi.org/10.1007/978-94-011-4926-6_8 (1998).
Meena et al.: Abiotic Stress Responses and Microbe-Mediated Mitigation in Plants: The Omics Strategies. Front Plant Sci. 8:172 doi:10.3389/fpls.2017.00172 [1-25] (2017).

Mirshekari et al.: Effect of seed biopriming with plant growth promoting rhizobacteria (PGPR) on yield and dry matter accumulation of spring barley (*Hordeum vulgare* L.) at various levels of nitrogen and phosphorus fertilizers. J. Food, Agric. and Environ. 10(3):314-320 (2012).
Moeinzadeh et al.: Biopriming of sunflower (*Helianthus annuus* L.) seed with Pseudomonas fluorescens for improvement of seed invigoration and seedling growth. Aust. J. Crop Sci. 4(7):564-570 (2010).
Molina-Romero et al.: Compatible bacterial mixture, tolerant to desiccation, improves maize plant growth. PLOS One. 12(11):e0187913 doi:10.1371/journal.pone.0187913 [1-21] (2017).
Muller et al.: Impact of formulation procedures on the effect of the biocontrol agent Serratia plymuthica HRO-C48 on Verticillium wilt in oilseed rape. BioControl 53(6):905-916 (2008).
Murunde et al.: Bio-priming to improve the seed germination, emergence and seedling growth of kale, carrot and onions. The Real IPM limited Company, P.O. Box 4001-01002 Madaraka, Thika, Kenya. Global Journal of Agricultual Research 6(3)26-34 (2018).
Ngumbi et al.: Bacterial-mediated drought tolerance: Current and future prospects. Appl. Soil Ecol. 105:109-125 doi:10.1016/j.apsoil.2016.04.009 (2016).
Niu et al.: Quantification of the Composition Dynamics of a Maize Root-associated Simplified Bacterial Community and Evaluation of Its Biological Control Effect. Bio-protocol 8(12):e2885 doi:10.21769/BioProtoc.2885 [1-17] (2018).
O'Callaghan: Microbial inoculation of seed for improved crop performance: issues and opportunities. Appl. Microbiol. Biotechnol. 100(13):5729-5746 doi:10.1007/s00253-016-7590-9 (2016).
PCT/US2020/028569 International Search Report and Written Opinion dated Sep. 18, 2020.
Pinedo et al.: Burkholderia phytofirmans PsJN induces long-term metabolic and transcriptional changes involved in *Arabidopsis thaliana* salt tolerance. Front. Plant Sci. 6:466 doi:10.3389/fpls.2015.00466 [1-17] (2015).
Pozo et al.: Impact of arbuscular mycorrhizal symbiosis on plant response to biotic stress: The role of plant defence mechanisms. Arbuscular Mycorrhizas: Physiology and Function, Springer 2nd Ed., Chapter 9, pp. 193-207 doi:10.1007/978-90-481-9489-6_9 (2010).
Raj et al.: Seed bio-priming with Pseudomonas fluorescens isolates enhances growth of pearl millet plants and induces resistance against downy mildew. Int. J. Pest Manag. 50:41-48 doi:10.1080/09670870310001626365 (2004).
Rosenblueth, et al. Bacterial endophytes and their interactions with hosts. Mol Plant Microbe Interact. Aug. 2006;19(8):827-37.
Ryan et al.: Bacterial endophytes: Recent developments and applications. FEMS Microbiol. Lett. 278(1):1-9 doi:10.1111/j.1574-6968.2007.00918.x (2008).
Santoro et al.: Plant growth-promoting effects of native Pseudomonas strains on *Mentha piperita* (peppermint): An in vitro study. Plant Biol. 17(6):1218-1226 doi:10.1111/plb.12351 (2015).
Sasse et al. Feed your friends: Do plant exudates shape the root microbiome? Trends in plant science. 23(1):25-41 doi:10.1016/j.tplants.2017.09.003 Zurich Open Repository and Archive, University of Zurich Library [1-37] (2018).
Savka et al.: Engineering bacterial competitiveness and persistence in the phytosphere. Mol Plant Microbe Interact. 15(9):866-874 doi:10.1094/MPMI.2002.15.9.866 (2002).
Schwember et al.: Oxygen interacts with priming, moisture content and temperature to affect the longevity of lettuce and onion seeds. Seed Science Research, 21(3):175-185 doi:10.1017/S0960258511000080 (2011).
Sessitsch et al.: The contribution of plant microbiota to economy growth. Microb. Biotechnol. 11(5):801-805 doi:10.1111/1751-7915.13290 (2018).
Shahzad et al.: Co-inoculation integrated with P-enriched compost improved nodulation and growth of Chickpea (*Cicer arietinum* L.) under irrigated and rainfed farming systems, Biol. Fertil. Soils 50(1):1-12 doi:10.1007/s00374-013-0826-2 (2014).
Sharifi et al.: Effect of seed priming with plant growth promoting Rhizobacteria ( PGPR ) on dry matter accumulation and yield of maize ( *Zea mays* L.) hybrids. Int. Res. J. Biochem. Bioinform. 1(3):076-083 (2011).

(56) References Cited

OTHER PUBLICATIONS

Song et al.: Seed defense biopriming with bacterial cyclodipeptides triggers immunity in cucumber and pepper. Sci. Rep. 7(1):1-15 doi:10.1038/s41598-017-14155-9 (2017).
Sturz et al.: Bacterial endophytes: Potential role in developing sustainable systems of crop production. CRC. Crit. Rev. Plant Sci. 19(1) doi:10.1080/07352680091139169 [1-30] (2000).
Sundaramoorthy et al.: Combinatorial effect of endophytic and plant growth promoting rhizobacteria against wilt disease of *Capsicum annum* L. caused by Fusarium solani. Biol. Control. 60(1):59-67 doi:10.1016/j.biocontrol.2011.10.002 (2012).
Tabassum et al.: Improving salt tolerance in barley by osmopriming and biopriming. Int. J. Agric. Biol. 20(11):2455-2464 doi:10.17957/IJAB/15.0788 (2018).
Tarquis et al.: Prehydration and priming treatments that advance germination also increase the rate of deterioration of lettuce seeds. Journal of Experimental Botany 43(3):307-317 doi.org/10.1093/jxb/43.3.307 (1992).
Taylor et al.: Concepts and technologies of selected seed treatments. Annu. Rev. Phytopathol. 28:321-339 doi:10.1146/annurev.py.28.090190.001541 (1990).
Timmermann et al.: Paraburkholderia phytofirmans PsJN Protects *Arabidopsis thaliana* Against a Virulent Strain of Pseudomonas syringae Through the Activation of Induced Resistance. Molecular Plant-Microbe Interactions. 30(3):215-230 doi:10.1094/MPMI-09-16-0192-R (2017).
Timmusk et al. Perspectives and Challenges of Microbial Application for Crop Improvement. Front. Plant Sci. 8(49):1-10 doi:10.3389/fpls.2017.00049 (2017).
United Nations: World Population Prospects 2017: Data Booklet [1-21] URL:https://www.un.org/development/desa/en/news/population/world-population-prospects-2017.html (2017).
Vacheron et al.: Fluorescent Pseudomonas Strains with only Few Plant-Beneficial Properties Are Favored in the Maize Rhizosphere. Front. Plant Sci. 7(1212):1-13 doi:10.3389/fpls.2016.01212 (2016).
Vacheron et al.: Plant growth-promoting rhizobacteria and root system functioning. Front. Plant Sci. 4(356):1-19 doi:10.3389/fpls.2013.00356 (2013).
Vaikuntapu et al.: Preferential Promotion of *Lycopersicon esculentum* (Tomato) Growth by Plant Growth Promoting Bacteria Associated with Tomato. Indian J. Microbiol. 54(4):403-412 doi:10.1007/s12088-014-0470-z (2014).
Van Loon: Plant responses to plant growth-promoting rhizobacteria. New Perspectives and Approaches in Plant Growth-Promoting Rhizobacteria Research. Eur. J. Plant Pathol. 119:243- 254 doi:10.1007/978-1-4020-6776-1_2 (2007).
Vejan et al.: Role of plant growth promoting rhizobacteria in agricultural sustainability—A review. Molecules 21(5):573 doi:10.3390/molecules21050573 [1-17] (2016).
Wang et al.: The effect of storage condition and duration on the deterioration of primed rice seeds. Frontiers in Plant Science 9(172):1-17 doi.org/10.3389/fpls.2018.00172 (2018).
Wright et al.: Application of beneficial microorganisms to seeds during drum priming. Biocontrol Sci. Technol. 13(6):599-613 doi:10.1080/09583150310001517992 (2003).
Yadav et al.: Seed bio-priming of baby corn emerged as a viable strategy for reducing mineral fertilizer use and increasing productivity. Sci. Hortic. (Amsterdam) 241(18):93-99 doi:10.1016/j.scienta.2018.06.096 (2018).
Yang et al.: Rhizosphere bacteria help plants tolerate abiotic stress. Trends Plant Sci. 14(1):1-4 doi:10.1016/j.tplants.2008.10.004 (2009).
Zoppellari et al.: Improvement of drought tolerance in maize (*Zea mays* L.) by selected rhizospheric microorganisms. Ital. J. Agrometeorol. 1:5-18 (2014).
Sharifi: Grain yield and physiological growth indices in maize (*Zea mays* L.) hybrids under seed biopriming with plant growth promoting rhizobacteria (PGPR). J. Food, Agric. Environ. 9(3):393-397 URL:https://doi.org/10.1234/4.2011.2290 (2011).
EP Application No. 20791570.3 Extended European Search Report dated Dec. 21, 2022.
Sharifi: Grain yield and physiological growth indices in maize (*Zea mays* L.) hybrids under seed biopriming with plant growth promoting rhizobacteria (PGPR). J. Food, Agric. Environ. 9(3):393-397 URL:https://doi.org/10.1234/4.2011.2290 (2011). [Resubmitting with Best Copy attachment].

\* cited by examiner

SEED TREATMENT METHODS AND COMPOSITIONS FOR IMPROVING PLANT TRAITS AND YIELD

CROSS-REFERENCE

This application is a continuation of U.S. application Ser. No. 17/503,196, filed Oct. 15, 2021, which is a continuation of International Application No. PCT/US2020/028569, filed Apr. 16, 2020, which claims the benefit of U.S. Provisional Application No. 62/835,281, filed Apr. 17, 2019, all of which are hereby incorporated by reference in their entirety.

SEQUENCE LISTING

The instant application contains a Sequence Listing which has been submitting electronically in ASCII format and is hereby incorporated by reference in its entirety. Said ASCII copy, created Nov. 5, 2021, is named "Andes_Ag_54449-701_302_SL Final.txt" and is 21,378,345 bytes in size.

FIELD OF THE INVENTION

The present invention relates to a seed treatment method consisting of introducing a plant-beneficial microorganism or a synthetic combination of two or more microorganisms and/or its exudates and/or its individualized biomolecules inside the seeds. The method involves a controlled and fast imbibition of seeds in an aqueous solution of a chemically inert but osmotically active compound supplemented with a specific amount of the beneficial microorganisms or a synthetic combination of two or more microorganisms and/or its exudates and/or its individualized biomolecules. The hydration of seeds and the incorporation of plant-beneficial microorganisms at early post-dormant stage of the plant embryo can promote rapid and uniform germination, improve seed vigor, enhance plant growth and improve plant traits even several months after the seed treatment.

BACKGROUND

By 2050, the world population is expected to reach 9.8 billion (https://www.un.org/development/desa/en/news/population/world-population-prospects-2017.html) while more than 500 million hectares of extended wild lands will change to cropland (IRP, 2017). Under current conditions, agricultural production has to face severe challenges due to climate change with extreme weather events and emerging pathogens, while farmers globally have cope with decreasing yields and low operating margins mainly due to the latter (GAP 2017; Sessitsch et al., 2018). When considering both, the expected worldwide population increase and the environmental damage, it is clear that in the next decade it will be a significant challenge to greatly increase agriculture and food production in a sustainable and environmentally friendly manner.

SUMMARY OF THE INVENTION

An aspect of the invention described herein is a method of incorporating bacteria into a plant seed, the method comprising: contacting said plant seed with a solution containing said bacteria, wherein said solution comprises about 0.1% to about 2% of a salt (w/v); and incubating said plant seed with said solution thereby incorporating at least 1 colony forming unit (CFU) of said bacteria into said plant seed. In some embodiments, (b) comprises incubating said plant seed with said solution thereby incorporating at least 500 CFU of said bacteria into said plant seed. In some embodiments, said bacteria comprises endospore forming bacteria or endospores thereof. In some embodiments, said solution comprises a microbial exudate. In some embodiments, said microbial exudate is derived from said bacteria. In some embodiments, said microbial exudate is not derived from said bacteria. In some embodiments, said bacteria comprise bacteria from the phyla Firmicutes, Proteobacteria, Actinobacteria, or a combination thereof. In some embodiments, said bacteria comprise bacteria from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terri bacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp., or a combination thereof. In some embodiments, said bacteria comprise bacteria from *Bacillus* sp. In some embodiments, said bacteria are incorporated between the seed coat and the embryo of said plant seed. In some embodiments, the method further comprises, prior to (a), disinfecting said plant seed. In some embodiments, said solution comprises about 0.85% said salt. In some embodiments, said salt comprises NaCl. In some embodiments, said plant seed comprises a maize seed, wheat seed, rice seed, sorghum seed, barley seed, rye seed, sugar cane seed, millet seed, oat seed, soybean seed, cotton seed, alfalfa seed, bean seed, quinoa seed, lentil seed, peanut seed, lettuce seed, tomato seed, pea seed, or a cabbage seed. In some embodiments, said solution further comprises Luria-Bertani (LB) broth. In some embodiments, said solution further comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof. In some embodiments, said solution further comprises calcium, magnesium, manganese, potassium, iron, or a combination thereof. In some embodiments, said solution is maintained at a temperature between about 4° C. to about 40° C.; about 20° C.

to about 40° C.; or about 10° C. to about 20° C. In some embodiments, said solution is maintained at about 23° C. or about 30° C. In some embodiments, said plant seed is incubated with said solution for about 1 minute to about 960 minutes, about 20 minutes to about 240 minutes, or about 1 minute to about 20 minutes. In some embodiments, said plant seed is incubated with said solution for about 1 minute, about 5 minutes, about 10 minutes, about 20 minutes, about 240 minutes, or about 960 minutes. In some embodiments, the method further comprises inducing endosporulation of said endospore forming bacteria.

Another aspect of the disclosure described herein is a modified plant seed comprising at least 1 CFU of bacteria incorporated between the seed coat and the embryo of said modified plant seed. In some embodiments, said modified plant seed comprises at least 500 CFU or at least 1000 CFU of said bacteria. In some embodiments, said bacteria comprises endospore forming bacteria or endospores thereof. In some embodiments, said modified plant seed comprises a microbial exudate. In some embodiments, said microbial exudate is derived from said bacteria. In some embodiments, said microbial exudate is not derived from said bacteria. In some embodiments, said bacteria comprise bacteria from the phyla Firmicutes, Proteobacteria, Actinobacteria, or a combination thereof. In some embodiments, said bacteria comprise bacteria from Acetonema sp., Actinomyces sp., Alkalibacillus sp., Ammoniphilus sp., Amphibacillus sp., Anaerobacter sp., Anaerospora sp., Aneurinibacillus sp., Anoxybacillus sp., Bacillus sp., Brevibacillus sp., Caldanaerobacter sp., Caloramator sp., Caminicella sp., Cerasibacillus sp., Clostridium sp., Clostridiisalibacter sp., Cohnella sp., Coxiella sp. Dendrosporobacter sp., Desulfotomaculum sp., Desulfosporomusa sp., Desulfosporosinus sp., Desulfovirgula sp., Desulfunispora sp., Desulfurispora sp., Filifactor sp., Filobacillus sp., Gelria sp., Geobacillus sp., Geosporobacter sp., Gracilibacillus sp., Halobacillus sp., Halonatronum sp., Heliobacterium sp., Heliophilum sp., Laceyella sp., Lentibacillus sp., Lysinibacillus sp., Mahela sp., Metabacterium sp., Moorella sp., Natroniella sp., Oceanobacillus sp., Orenia sp., Ornithinibacillus sp., Oxalophagus sp., Oxobacter sp., Paenibacillus sp., Paraliobacillus sp., Pelospora sp., Pelotomaculum sp., Piscibacillus sp., Planifilum sp., Pontibacillus sp., Propionispora sp., Salinibacillus sp., Salsuginibacillus sp., Seinonella sp., Shimazuella sp., Sporacetigenium sp., Sporoanaerobacter sp., Sporobacter sp., Sporobacterium sp., Sporohalobacter sp., Sporolactobacillus sp., Sporomusa sp., Sporosarcina sp., Sporotalea sp., Sporotomaculum sp., Syntrophomonas sp., Syntrophospora sp., Tenuibacillus sp., Tepidibacter sp., Terribacillus sp., Thalassobacillus sp., Thermoacetogenium sp., Thermoactinomyces sp., Thermoalkalibacillus sp., Thermoanaerobacter sp., Thermoanaeromonas sp., Thermobacillus sp., Thermoflavimicrobium sp., Thermovenabulum sp., Tuberibacillus sp., Virgibacillus sp., Vulcanobacillus sp., or a combination thereof. In some embodiments, said modified seed is a maize seed, wheat seed, rice seed, sorghum seed, barley seed, rye seed, sugar cane seed, millet seed, oat seed, soybean seed, cotton seed, alfalfa seed, bean seed, quinoa seed, lentil seed, peanut seed, lettuce seed, tomato seed, pea seed, or cabbage seed. In some embodiments, said plant seed comprises at least 1000 CFU of said microbe.

Another aspect of the disclosure described herein comprises a formulation containing at least $1 \times 10^3$ CFU/mL of one or more bacteria wherein said formulation comprises about 0.1% to about 2% a salt. In some embodiments, the formulation comprises 0.85% said salt. In some embodiments, said salt comprises NaCl. In some embodiments, said bacteria comprise endospore forming bacteria or endospores thereof. In some embodiments, said formulation comprises a microbial exudate. In some embodiments, said microbial exudate is derived from said bacteria. In some embodiments, said microbial exudate is not derived from said bacteria. In some embodiments, said bacteria comprise bacteria from the phyla Firmicutes, Proteobacteria, or Actinobacteria. In some embodiments, said bacteria comprise bacteria from Acetonema sp., Actinomyces sp., Alkalibacillus sp., Ammoniphilus sp., Amphibacillus sp., Anaerobacter sp., Anaerospora sp., Aneurinibacillus sp., Anoxybacillus sp., Bacillus sp., Brevibacillus sp., Caldanaerobacter sp., Caloramator sp., Caminicella sp., Cerasibacillus sp., Clostridium sp., Clostridiisalibacter sp., Cohnella sp., Coxiella sp. Dendrosporobacter sp., Desulfotomaculum sp., Desulfosporomusa sp., Desulfosporosinus sp., Desulfovirgula sp., Desulfunispora sp., Desulfurispora sp., Filifactor sp., Filobacillus sp., Gelria sp., Geobacillus sp., Geosporobacter sp., Gracilibacillus sp., Halobacillus sp., Halonatronum sp., Heliobacterium sp., Heliophilum sp., Laceyella sp., Lentibacillus sp., Lysinibacillus sp., Mahela sp., Metabacterium sp., Moorella sp., Natroniella sp., Oceanobacillus sp., Orenia sp., Ornithinibacillus sp., Oxalophagus sp., Oxobacter sp., Paenibacillus sp., Paraliobacillus sp., Pelospora sp., Pelotomaculum sp., Piscibacillus sp., Planifilum sp., Pontibacillus sp., Propionispora sp., Salinibacillus sp., Salsuginibacillus sp., Seinonella sp., Shimazuella sp., Sporacetigenium sp., Sporoanaerobacter sp., Sporobacter sp., Sporobacterium sp., Sporohalobacter sp., Sporolactobacillus sp., Sporomusa sp., Sporosarcina sp., Sporotalea sp., Sporotomaculum sp., Syntrophomonas sp., Syntrophospora sp., Tenuibacillus sp., Tepidibacter sp., Terribacillus sp., Thalassobacillus sp., Thermoacetogenium sp., Thermoactinomyces sp., Thermoalkalibacillus sp., Thermoanaerobacter sp., Thermoanaeromonas sp., Thermobacillus sp., Thermoflavimicrobium sp., Thermovenabulum sp., Tuberibacillus sp., Virgibacillus sp., Vulcanobacillus sp., or a combination thereof. In some embodiments, said bacteria comprise bacteria from Bacillus sp. In some embodiments, said formulation further comprises LB broth. In some embodiments, said formulation further comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof. In some embodiments, said formulation further comprises calcium, magnesium, manganese, potassium, iron, or a combination thereof. In some embodiments, said formulation is maintained at a temperature between about 4° C. to about 40° C.; about 20° C. to about 40° C.; or about 10° C. to about 20° C. In some embodiments, said formulation is maintained at about 23° C. or about 30° C. In some embodiments, said formulation contains at least $5 \times 10^5$ CFU/mL of said bacteria.

Another aspect of the disclosure described herein is a method of promoting a plant growth effect in a plant seed, the method comprising: contacting said plant seed with a solution containing bacteria, wherein said solution comprises about 0.1% to about 2% of a salt (w/v); and incubating said plant seed with said solution thereby incorporating at least 500 colony forming units (CFU) of said bacteria into said plant seed. In some embodiments, the method further comprises, prior to (a), disinfecting said plant seed. In some embodiments, said bacteria comprises endospore forming bacteria or endospores thereof. In some embodiments, said solution comprises a microbial exudate. In some embodiments, said microbial exudate is derived from said bacteria. In some embodiments, said microbial exudate is not derived from said bacteria. In some embodiments, said bacteria are incorporated between the seed coat and the embryo of said modified plant seed. In some embodiments, said solution comprises about 0.85% said salt. In some embodiments, said salt comprises NaCl. In some embodiments, said bacteria comprise bacteria from the phyla Firmicutes, Proteobacteria, Actinobacteria, or a combination thereof. In some embodiments, said bacteria comprise bacteria from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp., or a combination thereof. In some embodiments, said bacteria comprise bacteria from *Bacillus* sp. In some embodiments, said plant seed comprises a maize seed, wheat seed, rice seed, sorghum seed, barley seed, rye seed, sugar cane seed, millet seed, oat seed, soybean seed, cotton seed, alfalfa seed, bean seed, quinoa seed, lentil seed, peanut seed, lettuce seed, tomato seed, pea seed, or a cabbage seed. In some embodiments, said solution further comprises LB broth. In some embodiments, said solution further comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof. In some embodiments, said solution further comprises calcium, magnesium, manganese, potassium, iron, or a combination thereof. In some embodiments, said solution is maintained at a temperature between about 4° C. to about 40° C.; about 20° C. to about 40° C.; or about 10° C. to about 20° C. In some embodiments, said solution is maintained at about 23° C. or about 30° C. In some embodiments, said plant seed is incubated with said solution for about 1 minute to about 960 minutes, about 20 minutes to about 240 minutes, or about 1 minute to about 20 minutes. In some embodiments, said plant seed is incubated with said solution for about 1 minute, about 5 minutes, about 10 minutes, about 20 minutes, about 240 minutes, or about 960 minutes. In some embodiments, the method further comprises inducing endosporulation of said endospore forming bacteria. In some embodiments, said plant growth effect comprises yield increase, cell osmoregulation, ionic homeostasis, antioxidant defense, heat stress tolerance, maintenance of photosynthetic capacity, nitrogen fixation, or a combination thereof. In some embodiments, said bacteria are selected relative to said plant growth effect.

Another aspect of the disclosure described herein is a method of promoting a plant growth effect in a plant seed, the method comprising: contacting said plant seed with a solution containing microbial exudate, wherein said solution comprises about 0.1% to about 2% of a salt (w/v); and incubating said plant seed with said solution thereby incorporating said microbial exudate into said plant seed. In some embodiments, the method further comprises, prior to (a), disinfecting said plant seed. In some embodiments, said microbial exudate is derived from endospore forming bacteria or endospores thereof. In some embodiments, said microbial exudate is derived from non-endospore forming bacteria. In some embodiments, said microbial exudate is incorporated between the seed coat and the embryo of said modified plant seed. In some embodiments, said solution comprises about 0.85% said salt. In some embodiments, said salt comprises NaCl. In some embodiments, said microbial exudate is derived from bacteria from the phyla Firmicutes, Proteobacteria, Actinobacteria, or a combination thereof. In some embodiments, said microbial exudate is derived from bacteria from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp., or a combination thereof. In some embodiments, said microbial exudate is derived from bacteria from *Bacillus* sp. In some embodiments, said plant seed comprises a maize seed, wheat seed, rice seed, sorghum seed, barley seed, rye seed, sugar cane seed, millet seed, oat seed, soybean seed, cotton seed, alfalfa seed, bean seed, quinoa seed, lentil seed, peanut seed, lettuce seed, tomato seed, pea seed, or a cabbage seed. In some embodiments, said solution further comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof. In some embodiments, said solution is maintained at a temperature between about 4° C. to about 40° C.; about 20° C. to about 40° C.; or about 10° C. to about 20° C. In some embodiments, said solution is maintained at about 23° C. or about 30° C. In some embodiments, said plant seed is incubated with said solution for about 1 minute to about 960 minutes, about 20 minutes to about 240 minutes, or about 1 minute to about 20 minutes. In some embodiments, said plant seed is incubated with said solution for about 1 minute, about 5 minutes, about 10 minutes, about 20 minutes, about 240 minutes, or about 960 minutes. In some embodiments, said plant growth effect comprises yield increase, cell osmoregulation, ionic homeostasis, antioxidant defense, heat stress tolerance, maintenance of photosynthetic capacity, nitrogen fixation, or a combination thereof. In some embodiments, said microbial exudate is selected relative to said plant growth effect.

In one aspect, described herein, is an engineered seed comprising (i) a seed pericarp and a seed aleurone cell layer having an interspace therebetween; and (ii) one or more microbes disposed in the interspace. In another aspect, described herein, is an engineered seed comprising: (i) a seed pericarp and a seed aleurone cell layer; and (ii) one or more microbes disposed between the seed pericarp and seed aleurone cell layer. In certain embodiments, the one or more microbes are selected to produce a plant growth promoting effect. In certain embodiments, the seed is a monocot seed. In certain embodiments, the seed is selected from a maize, rice, and sorghum seed. In certain embodiments, the seed is a maize seed. In certain embodiments, the seed is a *Zea maize* seed. In certain embodiments, the seed is a dicot seed. In certain embodiments, the seed is selected from a soybean, wheat, cotton, alfalfa, lettuce, tomato, and cabbage seed. In certain embodiments, the seed is a lettuce seed. In certain embodiments, the seed is a *Lactuca sativa* seed. In certain embodiments, the seed is a tomato seed. In certain embodiments, the seed is a *Solanum lycopersicum* seed. In certain embodiments, the seed is a GMO seed. In certain embodiments, the seed is a non-GMO seed. In certain embodiments, the one or more microbes comprise a mixture of *Chryseobacterium lactis, Bacillus endophyticus*, and *Bacillus megaterium*. In certain embodiments, the one or more microbes comprise a mixture of *Acetobacter cereviseae, Chryseobacterium lactis, Bacillus endophyticus*, and *Bacillus megaterium*. In certain embodiments, the one or more microbes comprise a mixture of *Ensifer adhaerens* and *Bacillus nakamurai*. In certain embodiments, the one or more microbes comprise a mixture of *Ensifer adhaerens* and *Bacillus subtilis*. In certain embodiments, the one or more microbes comprises a mixture of *Ensifer adhaerens* and *Bacillus cucumis*. In certain embodiments, the one or more microbes comprise *Microbacterium yannicii*. In certain embodiments, the one or more microbes comprise *Microbacterium chocolatum*. In certain embodiments, the one or more microbes comprise *Serratioa ureilytica*. In certain embodiments, the one or more microbes comprise *Serratioa marcescens*. In certain embodiments, the one or more microbes comprise *Glutamicibacter arilaitensis*. In certain embodiments, the one or more microbes comprise *Glutamicibacter halophytocola*. In certain embodiments, the one or more microbes comprise *Ensifer adhaerens*. In certain embodiments, the one or more microbes comprises *Pantoea allii*. In certain embodiments, the one or more microbes comprises *Bacillus subtilis*. In certain embodiments, the one or more microbes comprises *Bacillus cucumis*. In certain embodiments, the one or more microbes comprise endospore forming microbes. In certain embodiments, the one or more microbes comprise a *Baccillus* sp. In certain embodiments, the one or more microbes is selected from the phyla Firmicutes, Proteobacteria, and Actinobacteria. In certain embodiments, the one or more microbes is selected from the phylum Firmicutes. In certain embodiments, wherein the one or more microbes is selected from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp. In certain embodiments, the one or more microbes is selected from the phylum Proteobacteria. In certain embodiments, the one or more microbes comprises *Actinomyces* sp. In certain embodiments, wherein the one or more microbes is selected from the phylum Actinobacteria. In certain embodiments, the one or more microbes comprises *Coxiella* sp. In certain embodiments, the one or more microbes form endospores after being disposed in the seed. In certain embodiments, the one or more microbes comprise a *Bacillus* sp. In certain embodiments, the one or more microbes comprise endospores. In certain embodiments, the one or more microbes comprises a 16S nucleic acid sequence of any of SEQ ID NOs:1-10221. In certain embodiments, the one or more microbes comprises a 16S nucleic acid sequence at least 99% identical to that of any of SEQ ID NOs:1-10221. In certain embodiments, the one or more microbes comprises a 16S nucleic acid sequence at least 98% identical to that of any of SEQ ID NOs:1-10221. In certain embodiments, the one or more microbes comprises a 16S nucleic acid sequence at least 95% identical to that of any of SEQ ID NOs:1-10221. In certain embodiments, the one or more microbes comprises a 16S nucleic acid sequence at least 90% identical to that of any of SEQ ID NOs:1-10221. In certain embodiments, the one or more microbes comprise genes coding for one or more compounds that trigger Induced Systemic Tolerance (IST). In certain embodiments, the one or more microbes comprise genes coding for one or more compounds that trigger Induced Systemic Resistance (ISR). In certain embodiments, the one or more microbes comprise genes coding for one or more compounds that trigger plant development. In certain embodiments, the one or more microbes comprise genes associated with nitrogen fixing. In certain embodiments, the one or more microbes comprise genes associated with phosphate solubilization. In certain embodiments, the one or more microbes comprise genes associated with phytohormone synthesis. In certain embodiments, the engineered seed further comprises a microbial exudate. In certain embodiments, the microbial exudate contains one or more compounds that trigger Induced Systemic Tolerance (IST). In certain embodiments, the microbial exudate contains one or more compounds that trigger Induced Systemic Resistance (ISR). In certain embodiments, the microbial exudate contains one or more compounds that trigger plant development. In certain embodiments, the microbial exudate is from an endospore forming bacteria. In certain embodiments, the microbial exudate is from a non-endospore forming bacteria. In certain embodiments, the microbial exudate is from a microbe comprising a 16S nucleic acid sequence of any of SEQ ID NOs:1-10221. In certain embodiments, the microbial exudate is from a microbe comprising a 16S nucleic acid sequence at least 99% identical to that of any of SEQ ID NOs:1-10221. In certain embodiments, the microbial exudate is from a microbe comprising a 16S nucleic acid sequence at least 98% identical to that of any of SEQ ID NOs:1-10221. In certain embodiments, the microbial exudate is from a microbe comprising a 16S nucleic acid sequence at least 95% identical to that of any of SEQ ID NOs:1-10221. In certain embodiments, the microbial exudate is from a microbe comprising a 16S nucleic acid sequence at least 90% identical to that of any of SEQ ID NOs:1-10221.

In certain aspects, described herein, is a method of treating one or more plant seeds, the method comprising: immersing the one or more seeds into a medium, the medium comprising a salt and one or more microbes selected to produce a plant growth promoting effect; and incubating the one or more seeds in the medium for a period of time sufficient to incorporate the one or more microbes into the seed. In another aspect, described herein, is a method of treating one or more plant seeds, the method comprising: immersing the one or more seeds into a medium, the medium comprising a salt and one or more microbes selected to produce a plant growth promoting effect; and incubating the one or more seeds in the medium to incorporate the bacteria between a pericarp and an aleurone cell layer. In certain embodiments, the one or more plant seeds remains in the dormant stage after treatment. In certain embodiments, the one or more plant seeds remains in the dormant stage after treatment. In certain embodiments, the one or more microbes are incorporated inside a seed pericarp. In certain embodiments, the one or more microbes are incorporated between a pericarp and aleurone cell layer. In certain embodiments, the method further comprises the step of removing the one or more seeds from the medium. In certain embodiments, the method further comprises the step of drying the one or more seeds. In certain embodiments, the one or more seeds is/are dried to about 10% of total seed moisture. In certain embodiments, the method further comprises the step of drying the one or more seeds to prevent germination. In certain embodiments, the method further comprises sterilizing the surface of the one or more seeds prior to immersing the one or more seeds in the medium. In certain embodiments, the method further comprises sterilizing the surface of the one or more seeds after immersing the one or more seeds in the medium. In certain embodiments, the method further comprises adding a fungicide to the surface of the seed. In certain embodiments, the one or more seeds comprise a monocot seed. In certain embodiments, the seed is selected from a maize, a rice, and a sorghum seed. In certain embodiments, the seed is a maize seed. In certain embodiments, the seed is a *Zea maize* seed. In certain embodiments, the seed is a dicot seed. In certain embodiments, the seed is selected from a soybean, wheat, cotton, alfalfa, lettuce, tomato, and cabbage seed. In certain embodiments, the seed is a lettuce seed. In certain embodiments, the seed is a *Lactuca sativa* seed. In certain embodiments, the seed is a tomato seed. In certain embodiments, the seed is a *Solanum lycopersicum* seed. In certain embodiments, the seed is a GMO seed. In certain embodiments, the seed is a non-GMO seed. In certain embodiments, the medium is an aqueous medium. In certain embodiments, the medium further comprises Poloxamer 188. In certain embodiments, the medium further comprises Poloxamer 188 at a concentration of 0.1%. In certain embodiments, the medium further comprises Tween 20. In certain embodiments, the medium further comprises one or more agent selected from the group of dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaureate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, and Poloxamer 407. In certain embodiments, the medium further comprises one or more ingredients that promote endosporulation of the one or more bacteria. In certain embodiments, the medium comprises potassium, ferrous sulfate, calcium, magnesium, manganese, or a combination thereof. In certain embodiments, the medium further comprises manganese. In certain embodiments, the medium comprises calcium, magnesium, and manganese. In certain embodiments, the medium further comprises nutrients for the one or more microbes. In certain embodiments, the medium is at room temperature. In certain embodiments, the medium is at a temperature of about 4° C. In certain embodiments, the medium is at a temperature of about 10° C. In certain embodiments, the medium is at a temperature of about 15° C. In certain embodiments, the medium is at a temperature is between about 4 and about 20° C. In certain embodiments, the medium is at a temperature is between about 30 and about 40° C. In certain embodiments, the medium is at a temperature of about 20° C. In certain embodiments, the medium is at a temperature of about 30° C. In certain embodiments, wherein the medium temperature is between about 20 and 24° C. In certain embodiments, wherein the medium is at a temperature of about 40° C. In certain embodiments, the salt comprises sodium chloride. In certain embodiments, the salt is at a concentration of 0.1-0.2%, 0.2-0.3%, 0.3-0.4%, 0.4-0.5%, 0.5-0.6%, 0.6-0.7%, 0.7-0.8%, 0.8-0.9%, 0.9-1.0%, 1.0-1.1%, 1.1-1.2%, 1.2-1.3%, 1.3-1.4%, or 1.4-1.5%. In certain embodiments, the salt is at a concentration of about 0.85%.

In certain embodiments, the salt is at a concentration of about 1.25% or less. In certain embodiments, the salt is at a concentration of about 1.25%. In certain embodiments, the one or more microbes is/are selected from *Acetobacter cereviseae*, *Chryseobacterium lactis*, *Bacillus endophyticus*, and *Bacillus megaterium*. In certain embodiments, the one or more microbes comprises *Acetobacter cereviseae*, *Chryseobacterium lactis*, *Bacillus endophyticus*, and *Bacillus megaterium*. In certain embodiments, the one or more microbes comprises *Chryseobacterium lactis*, *Bacillus endophyticus*, and *Bacillus megaterium*. the one or more microbes comprises *Ensifer adhaerens* and *Bacillus nakamurai*. In certain embodiments, the one or more microbes comprises *Ensifer adhaerens* and *Bacillus subtilis*. In certain embodiments, the one or more microbes comprises *Ensifer adhaerens* and *Bacillus Cucumis*. In certain embodiments, the one or more microbes comprises *Microbacterium yannicii*. In certain embodiments, the one or more microbes comprises *Microbacterium chocolatum*. In certain embodiments, the one or more microbes comprises *Serratioa ureilytica*. In certain embodiments, the one or more microbes comprises *Serratia marcescens*. In certain embodiments, the one or more microbes comprises *Glutamicibacter arilaitensis*. In certain embodiments, the one or more microbes comprises *Glutamicibacter halophytocola*. In certain embodiments, the one or more microbes comprises *Ensifer adhaerens*. In certain embodiments, the one or more microbes comprises *Pantoea* In certain embodiments, the one or more microbes comprises *Bacillus subtilis*. In certain embodiments, the one or more microbes comprises *Bacillus cucumis*. In certain embodiments, the one or more microbes comprise endospore forming microbes. In certain embodiments, the one or more microbes comprise a *Baccillus* sp. In certain embodiments, the one or more microbes is selected from the phyla Firmicutes, Proteobacteria, and Actinobacteria. In certain embodiments, the one or more microbes is selected from the phylum Firmicutes. In certain embodiments, the one or more microbes is selected from *Acetonema* sp., *Actinomyces* sp., *Alkalibacillus* sp., *Ammomphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., and *Vulcanobacillus* sp. In certain embodiments, the one or more microbes is selected from the phylum Proteobacteria. In certain embodiments, the one or more microbes comprises *Actinomyces* sp. In certain embodiments, the one or more microbes is selected from the phylum Actinobacteria. In certain embodiments, the one or more microbes comprises *Coxiella* sp. In certain embodiments, the one or more microbes form endospores after being incorporated into the seed. In certain embodiments, the one or more microbes comprise endospores. In certain embodiments, the one or more microbes comprise *Bacillus* endospores. In certain embodiments, the one or more microbes comprise a 16S nucleic acid sequence of any of SEQ ID NOs:1-10221. In certain embodiments, the one or more microbes comprise a 16S nucleic acid sequence at least 99% identical to that of any of SEQ ID NOs:1-10221. In certain embodiments, the one or more microbes comprise a 16S nucleic acid sequence at least 98% identical to that of any of SEQ ID NOs:1-10221. In certain embodiments, the one or more microbes comprise a 16S nucleic acid sequence at least 95% identical to that of any of SEQ ID NOs:1-10221. In certain embodiments, the one or more microbes comprise a 16S nucleic acid sequence at least 90% identical to that of any of SEQ ID NOs:1-10221. In certain embodiments, the medium further comprises a microbial exudate. In certain embodiments, the microbial exudate contains one or more compounds that trigger Induced Systemic Tolerance (IST). In certain embodiments, the microbial exudate contains one or more compounds that trigger Induced Systemic Resistance (ISR). In certain embodiments, the microbial exudate contains one or more compounds that trigger plant development. In certain embodiments, the microbial exudate is from an endospore forming bacteria. In certain embodiments, the microbial exudate is from a non-endospore forming bacteria. In certain embodiments, the microbial exudate is from a microbe comprising a 16S nucleic acid sequence of any of SEQ ID NOs:1-10221. In certain embodiments, the microbial exudate is from a microbe comprising a 16S nucleic acid sequence at least 99% identical to that of any of SEQ ID NOs:1-10221. In certain embodiments, the microbial exudate is from a microbe comprising a 16S nucleic acid sequence at least 98% identical to that of any of SEQ ID NOs:1-10221. In certain embodiments, the microbial exudate is from a microbe comprising a 16S nucleic acid sequence at least 95% identical to that of any of SEQ ID NOs:1-10221. In certain embodiments, the microbial exudate is from a microbe comprising a 16S nucleic acid sequence at least 90% identical to that of any of SEQ ID NOs:1-10221. In certain embodiments, the concentration of the one or more microbes in the medium is in the range of about $1 \times 10^6$ to $1 \times 10^{17}$ CFU/mL. In certain embodiments, the concentration of the one or more microbes in the medium is: $1 \times 10^6$ to $1 \times 10^7$ CFU/mL; $1 \times 10^7$ to $1 \times 10^8$ CFU/mL; $1 \times 10^8$ to $1 \times 10^9$ CFU/mL; $1 \times 10^9$ to $1 \times 10^{10}$ CFU/mL; $1 \times 10^{10}$ to $1 \times 10^{11}$ CFU/mL; $1 \times 10^{11}$ to $1 \times 10^{12}$ CFU/mL; $1 \times 10^{12}$ to $1 \times 10^{13}$ CFU/mL; $1 \times 10^{13}$ to $1 \times 10^{14}$ CFU/mL; $1 \times 10^{14}$ to $1 \times 10^{15}$ CFU/mL; $1 \times 10^{15}$ to $1 \times 10^{16}$ CFU/mL; or $1 \times 10^{16}$ to $1 \times 10^{17}$ CFU/mL. In certain embodiments, wherein the amount of the one or more microbes present in the medium is less than $10^{10}$ CFU/seed. In certain embodiments, the amount of the one or more microbes present in the medium is about $10^5$ to $10^9$ cells per gram of seed. In certain embodiments, the one or more microbes are selected to produce a plant growth promoting effect. In certain embodiments, the plant growth promoting effect of the one or more microbes is selected from one or more of the group comprising cell osmoregulation, ionic homeostasis, antioxidant defense, heat stress tolerance, and/or maintenance of photosynthetic capacity. In certain embodiments, the one or more microbes are selected for compatibility. In certain embodiments, the one or more microbes are selected to ensure no predatory or antagonistic effects will develop. In certain embodiments, the one or more microbes is/are also selected for stability during storage. In certain embodiments, the one or more microbes is/are also selected for rapid plant colonization and survival within associated tissues. In certain embodiments, the one or more microbes is/are also selected for stimulation of global, long-lasting physiological responses in a plant. In certain embodiments, the one or more microbes is selected for optimal incorporation into the one or more seeds. In certain embodiments, at least one of the microbes remains present throughout the plant life cycle. In certain embodiments, the incubation time is less than one minute. In certain embodiments, the incubation time is about one minute. In certain embodiments, the incubation time is less than 20 minutes. In certain embodiments, the incubation time is less than 4 hours. In certain embodiments, the incubation time is less than 16 hours. In certain embodiments, the incubation time is less than several days. In certain embodiments, the incubation time is less than 12 hours. In certain embodiments, greater than $1 \times 10^6$ bacterial cells are incorporated into each of the one or more seeds. In certain embodiments, between $1 \times 10^5$ and $1 \times 10^8$ bacterial cells are incorporated into each of the one or more seeds. In certain embodiments, the one or more microbes are incorporated into the one or more seeds stably. In certain embodiments, the incorporated one or more microbes is/are stable for greater than 30 days. In certain embodiments, the incorporated one or more microbes is/are stable for greater than six months. In certain embodiments, the incorporated one or more microbes is/are stable for at least one year. In certain embodiments, the incorporated one or more microbes is/are stable for at least two years.

In another aspect, described herein, is a plant seed treatment medium comprising salt and one or more microbes. In certain embodiments, the one or more microbes are selected to impart a plant growth promoting effect. In certain embodiments, the medium is an aqueous medium. In certain embodiments, the medium further comprises Poloxamer 188. In certain embodiments, the medium further comprises Poloxamer 188 at a concentration of 0.1%. In certain embodiments, the medium further comprises Tween 20. In certain embodiments, the medium further comprises one or more agent from the group comprising dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaureate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, and Poloxamer 407. In certain embodiments, the medium further comprises one or more ingredients that promote endosporulation of the one or more bacteria. In certain embodiments, the medium further comprises potassium, ferrous sulfate, calcium, magnesium, managanese, or a combination thereof. In certain embodiments, the medium further comprises manganese. In certain embodiments, the medium further comprises calcium, magnesium, and manganese. In certain embodiments, the medium further comprises nutrients for the selected one or more microbes. In certain embodiments, the salt comprises sodium chloride. In certain embodiments, the salt is at a concentration of 0.1-0.2%, 0.2-0.3%, 0.3-0.4%, 0.4-0.5%, 0.5-0.6%, 0.6-0.7%, 0.7-0.8%, 0.8-0.9%, 0.9-1.0%, 1.0-1.1%, 1.1-1.2%, 1.2-1.3%, 1.3-1.4%, or 1.4-1.5%. In certain embodiments, the salt is at a concentration of about 0.85%. In certain embodiments, the salt is at a concentration of about 1.25% or less. In certain embodiments, the salt is at a concentration of about 1.25%. In certain embodiments, the one or more microbes is/are selected from *Acetobacter cereviseae, Chryseobacterium lactis, Bacillus endophyticus*, and *Bacillus megaterium*. In certain embodiments, the one or more microbes comprises *Acetobacter* cereviseae, *Chryseobacterium lactis, Bacillus endophyticus*, and *Bacillus megaterium*. In certain embodiments, wherein the one or more microbes comprises *Chryseobacterium lactis, Bacillus endophyticus*, and *Bacillus megaterium*. In certain embodiments, the one or more microbes comprises *Ensifer adhaerens* and *Bacillus nakamurai*. In certain embodiments, the one or more microbes comprises *Ensifer adhaerens* and *Bacillus subtilis*. In certain embodiments, the one or more microbes comprises *Ensifer adhaerens* and *Bacillus cucumis*. In certain embodiments, the one or more microbes comprises *Microbacterium yannicii*. In certain embodiments, the one or more microbes comprises *Microbacterium chocolatum*. In certain embodiments, the one or more microbes comprises *Serratioa ureilytica*. In certain embodiments, the one or more microbes comprises *Serratioa marcescens*. In certain embodiments, the one or more microbes comprises *Glutamicibacter arilaitensis*. In certain embodiments, the one or more microbes comprises *Glutamicibacter halophytocola*. In certain embodiments, the one or more microbes comprises *Ensifer adhaerens*. In certain embodiments, the one or more microbes comprises *Pantoea* In certain embodiments, the one or more microbes comprises *Bacillus subtilis*. In certain embodiments, the one or more microbes comprises *Bacillus Cucumis*. In certain embodiments, the one or more microbes comprise endospore forming microbes. In certain embodiments, the one or more microbes comprises a *Baccilus* sp. In certain embodiments, the one or more microbes is selected from the phyla Firmicutes, Proteobacteria, and Actinobacteria. In certain embodiments, the one or more microbes is selected from the phylum Firmicutes. In certain embodiments, the one or more microbes is selected from *Acetonema* sp., *Actinomyces* sp., *Alkalibacillus* sp., *Ammomphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculurn* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaero-* bacter sp., *Thermoanaeromonas* sp., *Thermobacillus* sp., *Thermoflavimicrobium* sp., *Thermovenabulum* sp., *Tuberibacillus* sp., *Virgibacillus* sp., and *Vulcanobacillus* sp. In certain embodiments, the one or more microbes is selected from the phylum Proteobacteria. In certain embodiments, the one or more microbes comprises *Actinomyces* sp. In certain embodiments, the one or more microbes is selected from the phylum Actinobacteria. In certain embodiments, the one or more microbes comprises *Coxiella* sp. In certain embodiments, the one or more microbes form endospores after being incorporated into the seed. In certain embodiments, the one or more microbes comprise endospores. In certain embodiments, the one or more microbes comprise *Bacillus* endospores. In certain embodiments, the one or more microbes comprise a 16S nucleic acid sequence of any of SEQ ID NOs:1-10221. In certain embodiments, the one or more microbes comprise a 16S nucleic acid sequence at least 99% identical to that of any of SEQ ID NOs:1-10221. In certain embodiments, the one or more microbes comprise a 16S nucleic acid sequence at least 98% identical to that of any of SEQ ID NOs:1-10221. In certain embodiments, the one or more microbes comprise a 16S nucleic acid sequence at least 95% identical to that of any of SEQ ID NOs:1-10221. In certain embodiments, the one or more microbes comprise a 16S nucleic acid sequence at least 90% identical to that of any of SEQ ID NOs:1-10221. In certain embodiments, the medium further comprises a microbial exudate. In certain embodiments, the microbial exudate contains one or more compounds that trigger Induced Systemic Tolerance (IST). In certain embodiments, the microbial exudate contains one or more compounds that trigger Induced Systemic Resistance (ISR). In certain embodiments, the microbial exudate contains one or more compounds that trigger plant development. In certain embodiments, the microbial exudate is from an endospore forming bacteria. In certain embodiments, the microbial exudate is from a non-endospore forming bacteria. In certain embodiments, the microbial exudate is from a microbe comprising a 16S nucleic acid sequence of any of SEQ ID NOs:1-10221. In certain embodiments, the microbial exudate is from a microbe comprising a 16S nucleic acid sequence at least 99% identical to that of any of SEQ ID NOs:1-10221. In certain embodiments, the microbial exudate is from a microbe comprising a 16S nucleic acid sequence at least 98% identical to that of any of SEQ ID NOs:1-10221. In certain embodiments, the microbial exudate is from a microbe comprising a 16S nucleic acid sequence at least 95% identical to that of any of SEQ ID NOs:1-10221. In certain embodiments, the microbial exudate is from a microbe comprising a 16S nucleic acid sequence at least 90% identical to that of any of SEQ ID NOs:1-10221. In certain embodiments, the concentration of the one or more microbes in the medium is in the range of about $1\times10^6$ to $1\times10^{17}$ CFU/mL. In certain embodiments, the one or more microbes in the medium is in the range of about $1\times10^6$ to $1\times10^{17}$ CFU/mL. In certain embodiments, the concentration of the one or more microbes in the medium is: $1\times10^6$ to $1\times10^7$ CFU/mL; $1\times10^7$ to $1\times10^8$ CFU/mL; $1\times10^8$ to $1\times10^9$ CFU/mL; $1\times10^9$ to $1\times10^{10}$ CFU/mL; $1\times10^{10}$ to $1\times10^{11}$ CFU/mL; $1\times10^{11}$ to $1\times10^{12}$ CFU/mL; $1\times10^{12}$ to $1\times10^{13}$ CFU/mL; $1\times10^{13}$ to $1\times10^{14}$ CFU/mL; $1\times10^{14}$ to $1\times10^{15}$ CFU/mL; $1\times10^{15}$ to $1\times10^{16}$ CFU/mL; or $1\times10^{16}$ to $1\times10^{17}$ CFU/mL.

In another aspect, described herein, is a method of treating one or more plant seeds, the method comprising: immersing the one or more seeds into a medium, the medium comprising a salt and one or more microbial exudates selected to produce a plant growth promoting effect; and incubating the one or more seeds in the medium for a period of time sufficient to incorporate the one or more microbial exudates into the seed. In certain embodiments, the microbial exudate contains one or more compounds that trigger Induced Systemic Tolerance (IST). In certain embodiments, the microbial exudate contains one or more compounds that trigger Induced Systemic Resistance (ISR). In certain embodiments, the microbial exudate contains one or more compounds that trigger plant development. In certain embodiments, the microbial exudate is from an endospore forming bacteria. In certain embodiments, the microbial exudate is from a non-endospore forming bacteria. In certain embodiments, the microbial exudate is from a microbe comprising a 16S nucleic acid sequence of any of SEQ ID NOs:1-10221. In certain embodiments, the microbial exudate is from a microbe comprising a 16S nucleic acid sequence at least 99% identical to that of any of SEQ ID NOs:1-10221. In certain embodiments, the microbial exudate is from a microbe comprising a 16S nucleic acid sequence at least 98% identical to that of any of SEQ ID NOs:1-10221. In certain embodiments, wherein the microbial exudate is from a microbe comprising a 16S nucleic acid sequence at least 95% identical to that of any of SEQ ID NOs:1-10221. In certain embodiments, the microbial exudate is from a microbe comprising a 16S nucleic acid sequence at least 90% identical to that of any of SEQ ID NOs:1-10221. In certain embodiments, the salt comprises sodium chloride. In certain embodiments, the salt is at a concentration of 0.1-0.2%, 0.2-0.3%, 0.3-0.4%, 0.4-0.5%, 0.5-0.6%, 0.6-0.7%, 0.7-0.8%, 0.8-0.9%, 0.9-1.0%, 1.0-1.1%, 1.1-1.2%, 1.2-1.3%, 1.3-1.4%, or 1.4-1.5%. In certain embodiments, the salt is at a concentration of about 0.85%. In certain embodiments, the salt is at a concentration of about 1.25% or less. In certain embodiments, the salt is at a concentration of about 1.25%. In certain embodiments, the microbial exudate is derived from *Microbacterium yannicii*. In certain embodiments, the microbial exudate is derived from *Microbacterium chocolatum*. In certain embodiments, the microbial exudate is derived from *Serratioa ureilytica*. In certain embodiments, the microbial exudate is derived from *Serratioa marcescens*. In certain embodiments, the microbial exudate is derived from *Glutamicibacter arilaitensis*. In certain embodiments, the microbial exudate is derived from *Glutamicibacter halophytocola*. In certain embodiments, wherein the microbial exudate is derived from *Ensifer adhaerens*. In certain embodiments, the microbial exudate is derived from *Acetobacter cerevisiae*. In certain embodiments, the microbial exudate is derived from *Pantoea allii*. In certain embodiments, the microbial exudate is derived from *Bacillus subtilis*. In certain embodiments, the microbial exudate is derived from *Bacillus cucumis*. In certain embodiments, the microbial exudate is derived from a microbe selected from the phyla Firmicutes, Proteobacteria, and Actinobacteria. In certain embodiments, the microbial exudate is derived from a microbe selected from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp.,

*Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp. and *Vulcanobacillus* sp. In certain embodiments, the microbial exudate is derived from a microbe selected from the phylum Proteobacteria. In certain embodiments, the microbial exudate is derived from *Actinomyces* sp. In certain embodiments, the microbial exudate is derived from a microbe selected from the phylum Actinobacteria. In certain embodiments, the microbial exudate is derived from *Coxiella* sp. In certain embodiments, the microbial exudate is derived from a *Bacillus* sp.

INCORPORATION BY REFERENCE

All publications, patents, and patent applications mentioned in this specification are herein incorporated by reference to the same extent as if each individual publication, patent, or patent application was specifically and individually indicated to be incorporated by reference. To the extent publications and patents or patent applications incorporated by reference contradict the disclosure contained in the specification, the specification is intended to supersede and/or take precedence over any such contradictory material.

BRIEF DESCRIPTION OF THE FIGURES

The patent or application file contains at least one drawing executed in color. Copies of this patent or patent application publication with color drawing(s) will be provided by the Office upon request and payment of the necessary fee.

The novel features of the methods and compositions described herein are set forth with particularity in the appended claims. A better understanding of the features and advantages of the present methods and compositions described herein will be obtained by reference to the following detailed description that sets forth illustrative embodiments, in which the principles of the methods and compositions described herein are utilized, and the accompanying drawings of which:

DETAILED DESCRIPTION

Figure 1:
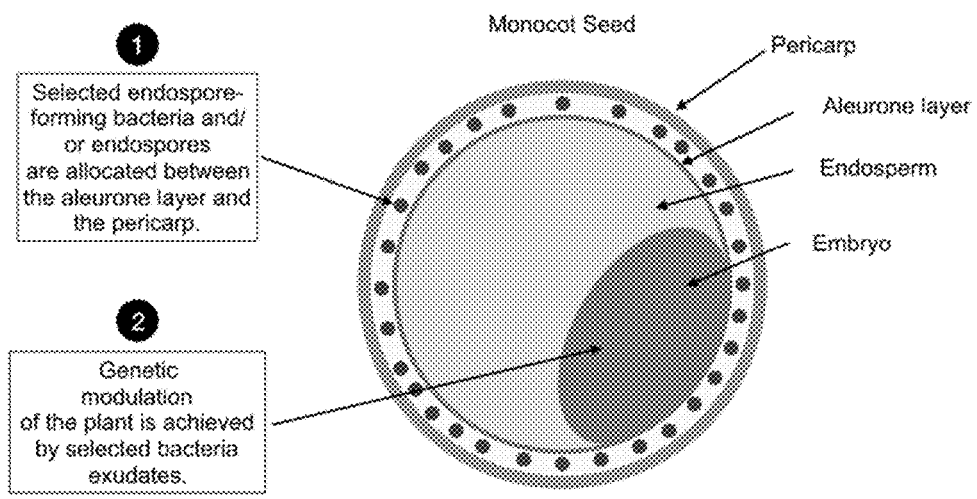
FIG. 1 depicts the two-stage plant enhancement strategy through the implementation of the proposed invention. 101 exemplifies a monocot seed. The seed treatment processes described herein incorporate bacteria (or endospores thereof) 106 between the aleurone layer 103 and the pericarp 102. The aleurone layer 103 separates the endosperm 104 from the outer layers. The promotion of a plant growth effect described herein results from genetic modulation of the plant embryo 105 by the bacteria 106 and/or the bacterial exudates.

While various embodiments of the invention have been shown and described herein, it will be obvious to those skilled in the art that such embodiments are provided by way of example only. Numerous variations, changes, and substitutions may occur to those skilled in the art without departing from the invention. It should be understood that various alternatives to the embodiments of the invention described herein may be employed.

Agriculture is one of the human activities that contributes most to the environmental damage with potential risks to human health. The agriculture activity causes land erosion, nutrient depletion, acidification, salinization, compaction, chemical pollution and causes moderately to highly degradation of soils. In particular, the conventional farming methods depend strongly on the use of synthetic fertilizers and pesticides in order to improve crop yields. These products are primarily used in the agricultural sector but also in forestry, home gardens and in recreation areas. These chemical pollutants may pose environmental risks during both their production and application. Their overuse results in an imbalance of essential nutrients in soils, potential negative impacts in soil microbiota and soil meiofauna, and may eventually render the land unsuitable for farming Our society is now demanding more sustainable production systems and several countries' regulatory framework does not accept the use of genetic modification to improve crop traits; further, many chemicals will be removed from markets in the upcoming years (Sessitsch et al., 2018; Timmusk et al., 2017). Such consumer pressure has favored the withdrawal of many synthetic compounds and the lowering of maximum residue limits imposed by the regulatory environment. For instance, regulation towards the restriction and decrease of nitrogen-based fertilizers and pesticides is increasing worldwide due to their proved deleterious effects on both human and environment health (such as greenhouse gases, global warming, water pollution, reduction of biological nitrogen fixation in the soil, losses of soil biodiversity and genetic resources, etc.). In addition, costs of development and registration of synthetic pesticides have been escalating, leading to significant reductions in development and launch of new chemistries (O'Callaghan, 2016).

One potential way to address this problem is through the use of microbial technologies for agriculture, to improve more efficaciously the productivity and yields of important cultivars (Timmusk et al., 2017). The plant-associated microbiota has been extensively explored in the last decades (Sessitsch et al., 2018), showing that colonizing microbial communities play a fundamental role in determining the rate and extent of plant growth, providing, in certain cases, the nutrients and conditions necessary for survival and/or directly stimulating plant development and the response to environmental challenge. Thus, it has been shown that microbial colonization of the phytosphere starts from germination, and continues through-all the plant life cycle, extending to the complete surface of the plant, and concentrating in the rhizosphere (Bais et al., 2006) where high nutrient and water availability from root exudates create a suitable environment for microbial growth (Badri and Vivanco, 2009). It has been also demonstrated that root exudation of diverse aromatic compounds can inhibit the growth of certain microorganisms, while stimulating the proliferation of others, making the rhizosphere a selective environment (Badri et al., 2013; Ledger et al., 2012, Sasse et al., 2018). Moreover, relevant members of the microbiota respond to root exudate composition changes that occur through plant development, expressing catabolic functions that are key to plant growth (Chaparro et al., 2013). Conversely, microbial colonization can modify the flow and pattern of root exudation, suggesting that a continuous communication is established with the host (Bais et al., 2006). A more intimate association develops among plants and microorganisms that colonize their internal tissues without causing harm or signs of infection (Sturz et al., 2000). These endophytic microorganisms have been shown to comprise a large number and diversity of bacteria (Ryan et al., 2008), that can be found in plant roots, stems, leaves, seeds, fruits, tubers, and root nodules (Rosenblueth and Martinez-Romero, 2006). Beneficial or mutualistic bacteria, usually known as plant growth promoting bacteria (PGPB), frequently colonize the rhizosphere and internal tissues of plants (Lugtenberg and Kamilova, 2009), as well as the surface of leaves and stems, usually known as the phyllosphere, where microbial populations are referred to as epiphytic microorganisms.

The ability of PGPB to increase plant growth has been well established, and it can proceed through different molecular mechanisms; e.g. by improving nutrient supply (nitrogen fixation, phosphate solubilization, etc.), modulation of plant hormonal balance (via production of auxins, cytokinins, nitric oxide (NO), etc., or deamination of ACC), by enhancing plant defense caused by fungi, bacteria, viruses, herbivores and nematodes (through induction of systemic resistance pathways and/or production of antimicrobial secondary metabolites, extracellular lytic enzymes, surfactants or volatile organic compounds) and by improving tolerance to abiotic stresses (salinity, drought, high and low temperature, heavy metals, etc.) (Dimkpa et al., 2009; Kloepper et al., 2004; Lugtenberg and Kamilova, 2009; Ledger et al., 2016; Timmermann et al., 2017; Vacheron et al., 2013; Van Loon, 2007; Yang et al., 2009). In this context, the PGPB have gained popularity as microbial inoculants and a number of new products have recently been formulated (PCT/US2016/017204; US2016/0338360A1; US2016/0330976A1; US2017/0223967A1; US2018/0020677A1; Sessitsch et al., 2018).

Improving Agricultural Plant Traits by Effect of Plant-Associated Bacteria

There has been a wide adoption of PGPB inoculation in regular agricultural practice in the last 20 years. However, the lack of scientific knowledge regarding the ecology, physiology and biochemistry of associative plant-bacteria interactions makes this biotechnology still deficient for industrial application. In this sense, efforts to strengthen inoculation technology in non-leguminous crops with PGPB need to incorporate a broader understanding such as the physiological status of the inoculated microorganisms and/or, higher viability under adverse conditions in soil and/or during storage. Similarly, when bacteria are in co-interaction with crop plants, the expression of genes involved in plant growth promotion may be fundamental to obtain the beneficial effect. These genes could be turned on or off, depending on environmental conditions, affecting their expression in the agricultural field, which could explain why some bacteria improve the growth of plants under laboratory-controlled environments, but frequently fail under field conditions or, as shown in other cases, display variable results (Baez-Rogelio et al., 2017).

Despite the importance of plant-PGPB interactions, only a few abilities of these microbes have been clearly and directly associated with plant growth promotion and protection. For instance, the solubilization of inorganic nutrients that are rate-limiting for plant growth, the capability to fix atmospheric nitrogen, the stimulation of nutrient delivery and uptake by plant roots, and the modulation of plant regulatory mechanisms through the production of hormones such as auxin and/or ethylene, gibberellins, cytokinins, volatile organic compounds (VOCs) and other metabolites, have been associated with plant development.

Usually, agricultural plants are exposed to multiple stresses simultaneously. As stress factors cause detrimental impacts on the functionality/productivity of agricultural systems, the role of rhizosphere microorganisms is crucial in helping plants to thrive in adverse conditions (Barea, 2015). As strategy to survive or reproduce, the stressed plants can induce changes in their plant morphology, physiology, transporter activity and root exudation profiles, to recruit microbes with stress-alleviating capacities. However, the mechanisms involved in plant-microbe interactions under stress situations are poorly understood (Barea, 2015). This understanding is relevant to design biotechnological strategies to optimize plant adaptation mechanisms and to improve the ability of soil microbes for stress alleviation in crops (Pozo et al., 2010).

Diverse types of stress, including salinity, drought, nutrient deficits, high and low temperature, diseases and pests, among others, can alter plant-microbe interactions in the rhizosphere and severely impact agriculture productivity. For instance, the level of aridity in many land areas of the world has increased progressively due to drought, salinity problems and high temperatures. Among them, drought is one of the most threatening abiotic stresses to food production worldwide and is expected to cause serious plant growth problems for crops on more than 50% of the Earth's arable lands by 2050 (Ngumbi and Kloepper, 2016). In turn, salinity is other major limitation in agriculture, affecting approximately 20% of the irrigated land worldwide and more than 100 countries. This percentage is increasing due to natural causes, agricultural practices and global climate change. Salt-affected soils can be divided into saline, saline-sodic and sodic, depending on salt amounts, type of salts, amount of sodium present and soil alkalinity. Each type of salt-affected soil has different characteristics, which will also determine the way they can be managed. In 1995, it was estimated that salinization of irrigated lands caused losses of annual income of about US$12 billion globally. Furthermore, decreased availability of water, mainly produced by changing climatic conditions, misuse and overuse of available freshwater sources, and the use of saline water sources (both of marine origin or in-land high conductivity sources, and mainly provoked by the freshwater availability restrictions), makes abiotic saline stress, a current, highly relevant problem for agronomic procedures.

To cope with osmotic stressors (salinity and drought) plants must develop a number of adaptation mechanisms including mainly a fine regulation of their water uptake capacity and transpiration rates, and the activation of the antioxidant machinery to overcome the overproduction of reactive oxygen species (ROS) caused by the stress. Maintaining water and ROS balance may be ameliorated by inoculation with PGPB, which can act through diverse specific mechanisms: i)—cell osmoregulation (related to the accumulation of the compatible solutes such as proline, glycine, betaine, soluble sugars, pinitol and mannitol); ionic homeostasis (based on maintaining a fine balance of potassium, sodium, calcium and their ratios); antioxidant defense (to compensate the production of harmful reactive oxygen species (ROS); and iv)—maintenance of photosynthetic capacity. The modification of root system architecture is other important adaptive traits that plants possess to endure drought. A good correlation between PGPB inoculation and drought resistance has been reported in several crops, including soybean, chickpea, and wheat (Ngumbi and Kloepper, 2016). Therefore, there is a renewed interest in finding solutions to water-related problems. In particular, there is a need to find solutions that increase plant tolerance to drought and salinity stress and contribute to enhance growth of crops that satisfy food demands under limited water resource availability. Improvement of plant salt-stress tolerance using PGPB has emerged as a promising strategy to help overcome this limitation but only a few reports have focused on plant-PGPB interactions under salt stress (Ledger et al., 2016; Pinedo et al., 2015). Consequently, microbiologically inoculated plants allow a better regulation of plant water status and to have higher transpiration and photosynthetic rates under conditions of water deficit. *Bacillus megaterium* strain inoculated into maize roots increased the ability of the root to absorb water under salinity conditions (Marulanda et al., 2010). A similar behavior was observed when *Pantoea agglomerans* was inoculated into the maize roots (Gond et al., 2015). Additionally, under salt stress, the inoculation with *Azospirillum* sp. improves the quality and storage life of lettuce (Fasciglione et al., 2015).

Aridity also imparts abiotic stress on plants due to high temperature. Plant reactions to high temperatures are complex and involve alterations at the physiological, molecular and biochemical levels and altered gene expression leading to a complex array of signaling and limiting plant growth, productivity and the grain quality and yield (Vejan et al., 2016). More specifically, heat stress affects protein denaturation and aggregation, fluidity of membrane lipids, inactivation of enzymes in chloroplast and mitochondria, inhibition of protein synthesis and loss of membrane integrity (Howarth, 2005). These injuries eventually lead to starvation, inhibition of growth, reduced ion flux, production of toxic compounds and reactive oxygen species (ROS). To overcome productivity and yield losses due to high temperature, the improvement of thermotolerance by PGPB inoculation strategies is a cost-effective biotechnology tool, which could be adopted by farmers globally. As example, the inoculation of the plant growth promoting *Pseudomonas* sp. strain AKM-P6 and the thermotolerant *P. putida* strain c enhanced the tolerance of sorghum and wheat seedlings to high temperature stress, respectively, due to the synthesis of high-molecular weight proteins and also improved the levels of cellular metabolites (Ali et al., 2009; Zulfikar Ali et al., 2011). However, the effectiveness of microbial inoculants under field conditions is still challenging since issues of host specificity, weak shelf-life, poor predictability and/or low survival of the inoculants under environmental conditions causes strong limitations for their application to mitigate heat and other abiotic stress on crops (de Freitas and Germida, 1992; Kaur et al., 2018; Meena et al., 2017; Zulfikar Ali et al., 2011). Several conflicting results of the effect of PGPB inoculation on increasing crop yield at field trials were reported under different temperature and climatic regions, cropping systems and agronomic management conditions (Leggett et al., 2015, 2017). Thus, crop yield statistics needs to be robustly tackled due to both logistical constraints, the associated cost of sampling, as well as the underlying complexity of environmental factors that arbitrate attainable yield (e.g., in relation to theoretical/potential yield).

Synthetic Consortia of Plant-Associated Bacteria

A promising strategy to improve the field performance of phytostimulating microbial inoculants is the design of synthetic microbial consortia that may overcome the efficacy limitations displayed by isolated microorganisms. Several studies reporting the greater potential of co-inoculating seeds or plants with combinations of multiple beneficial bacteria, in terms of the resulting plant growth promotion and biological control, than inoculation with a single bacterial species (Kumar, 2016; Sundaramoorthy et al., 2012) (Oliveira et al., 2009). The use of such consortiums as inoculants may pose an advantage, since different plant growth-promoting bacteria have been proven to interact synergistically with the plant host to provide nutrients, remove inhibitory products, or stimulate growth (Barea et al., 2002; Zoppellari et al., 2014). Furthermore, they have been found to stimulate the survival of one another through metabolic complementarity, inhibition of predators, biofilm protection and/or quorum sensing.

Regarding nutrient acquisition, specific examples of the superior performance of synthetic consortia include co-inoculation of chickpea with *Serratia marcescens* (SF3), *Serratia* spp. (ST9), and *Mesorhizobium ciceri*, which increased the number of nodules per plant, nodule dry weight, number of pods per plant, grain yield, protein content, and total chlorophyll content under irrigated and rainfed conditions, when compared to inoculation with single bacterial strains (Shahzad et al., 2014). On the other hand, sugarcane inoculation with a consortium of 5 diazotrophic bacteria (*Gluconacetobacter diazotrophicus, Herbaspirillum seropedicae, Herbaspirillum rubrisubalbicans, Azospirillum amazonense*, and *Paraburkholderia tropica*) also showed higher stem production in two soils with low-to medium levels of chemical fertilizer compared to mono-inoculated plants (Oliveira et al., 2009).

Biological control and induced plant defenses are also potentiated when co-inoculated consortia are compared to application of individual strains, as shown in the case of the protective endophytic strains *Bacillus subtilis* EPCO16 and *Bacillus subtilis* EPC5, when combined with the compatible rhizobacterial strain *Pseudomonas fluorescens* Pf1, in terms of protection against chili wilt disease caused by *Fusarium solani* and induction of an induced systemic resistance (ISR) response in the plant host. Induction of defensive enzymes in the plant, and metabolic pathways involved in the synthesis of phytoalexins, showed that combinations of the three bacteria were more effective than addition of each separate strain (Sundaramoorthy et al., 2012). Furthermore, a comparison between separate and combined plant inoculation with fluorescent *Pseudomonas aeruginosa* (PHU094), *Trichoderma harzianum* (THU0816) and *Mesorhizobium* sp. (RL091), was made for plant growth promotion and defense induction in chickpea plants challenged by the pathogenic fungus *Sclerotium rolfsii*. Results demonstrated that the most effective treatment was combined application of PHU094, THU0816 and RL091, either in the presence or absence of pathogenic challenge (Sigh et al., 2014).

Inoculation of synthetic consortia has also been proven more effective than individual strains under conditions of abiotic stress. For example, when four compatible and desiccation-tolerant PGPB strains, including *Pseudomonas putida* (KT2440), *Sphingomonas* sp. (OF178), *Azospirillum brasilense* (Sp7) and *Acinetobacter* sp. (EMM02), were tested as growth promoters of maize plants. The plants inoculated with the bacterial consortium outperformed plants inoculated with individual bacteria, in general, and this advantage was also observed when the inoculated seeds underwent desiccation stress before germination, showing a strong protective potential for the synthetic consortium for dry land agriculture applications (Molina-Romero et al., 2017). In addition, *Pseudomonas putida* (NBRIRA) and *Bacillus amyloliquefaciens* (NBRISN13) with several PGPB traits were evaluated for their synergistic effect to ameliorate drought stress in chickpea, showing that plant growth parameters were significantly higher in consortium inoculated plants as compared to the effects of individual PGPB (Kumar, 2016).

In general, isolated microorganisms are considered to be limited in their plant growth promoting action because of a) a restricted host range relative to their beneficial effects, as has been shown for *Aeromonas, Pseudomonas, Bacillus* and *Enterobacter* strains isolated from tomato plants (Vaikuntapu et al., 2014) and *Azospirillum* strains obtained from different rice varieties (Chamam et al., 2013); b) poor resilience to changes in their environmental conditions (as reviewed in (Mahmood et al., 2016)); c) higher susceptibility to antagonism or predation by the native microbiota (Savka et al., 2002); d) lower competitiveness with respect to the native, well-adapted host microbiota, as demonstrated when compared with native *Pseudomonas* strains improving growth of *Mentha piperita* (Santoro et al., 2015). Furthermore, the rhizosphere environment tends to favor association with different microorganisms harboring few or single plant growth promoting functions that complement each other to foster plant growth, rather than single bacteria expressing many complementary functions (Vacheron et al., 2016).

Next Generation of Microbial Inoculants

Despite the fact that inoculation of plants with beneficial bacteria is a century-old technology, microorganism-based technologies for agriculture are now posed as the most revolutionary and environmentally friendly biotechnology for increasing agriculture production, based on balancing the economic costs and the economic benefits against the agroecosystem preservation (Berninger et al., 2018; Cassán and Diaz-Zorita, 2016; Dunham Trimmer, 2017).

A series of microbial inoculants have appeared on the commercial market but the application of PGPB in crops still implies a substantial technological challenge. Several factors have been described to limit the effectiveness of isolated microorganisms or synthetic consortia as agricultural products designed to enhance plant growth and/or induce systemic tolerance to environmental stresses (adverse factors such as soil types, climatic conditions, crop variety, bacterial genotype, effectiveness of the bacterial isolates, poor quality of the inoculant, the proper inoculation technology or the production technology is limited). Thus, bacterial formulations with PGPB do not usually achieve the desired effectiveness in field applications, and are regularly incompatible with standard agricultural practices (Bashan, 1998; Bashan et al., 2014). Accordingly, next generation microbial technologies for traditional and organic agriculture must overcome these significant current limitations. The formulations and methods described herein overcome these limitations.

Microbial Inoculation Techniques on Seeds for Improved Crop Performance

For sustainable and precision agriculture a current challenge is to better manage microorganisms to develop more robust and effective bioinoculants. Regardless of the purpose for which beneficial microorganisms are applied to crops, they must be applied in a way that optimizes and assures their functionality. Several reports have shown different techniques for delivering PGPB microorganisms, such as liquids (for spray application, drenching or root dipping) or as dry formulations ((Barea, 2015; O'Callaghan, 2016) (and references therein)). However, many of these approaches are not economically efficient or feasible on a large-scale scenario because of the amount of microbial inoculum needed (particularly in broad acre crops) and due to other environmental and operational factors which can diminish its survival and functionality of the microorganism (such as drought, high temperatures, contamination, field soil microbiota, microbiological-unsuitable management, etc).

Well-known limitations on field application of bioinoculants are the following:

Farm-handling qualities: A major concern for the growers relies on the ease handling of the inoculants and if possible, the application using the standard seeding machinery. In addition, it is uncommon that farm practices change to accommodate a high quality inoculant technology using specialized machinery (Date, 2001).

Long storage quality: The inoculant should have enough shelf-life. One to two years at room temperature are often necessary for successful integration of the microbial technology into current agricultural distribution system (Deaker et al., 2011).

Inoculants performance: A microbial formulation must be stable during production, distribution, storage, and transportation to the farmer, particularly when the main ingredient is alive and susceptible to changes, as when compared to farm chemicals. When formulating a microorganism into an affordable product used by microbiologically-unskilled farmers, is a difficult task mainly because: i)—under precise laboratory conditions a microbial strain may function optimally and similar results under field condition are expected, but conditions in the farm might be not ideal bioinoculants are usually liquid or solid formulations and if they are wrongly stored (e.g. at high or room temperatures), or wrongly mixed or diluted, it may diminished the microbial viability and thus its beneficial effect on field. Cross-contamination by other microorganisms might also occur having negative effect on the original bioinoculants (Bashan et al., 2014; Mahmood et al., 2016) and eventually on the crops too.

Method of inoculation: applying bioinoculant directly to a seed contributes to the survival and efficiency of the bacteria in the soil and on the plant. In some implementations, the effectiveness of the beneficial effects of microorganisms in the plant is limited by certain biotic and abiotic factors (including soil temperature and moisture, nutrient presence and pH), the storage conditions of the product, and its shelf-life (Calabi-Floody et al., 2018; Mahmood et al., 2016; Taylor et al., 1998).

The application of beneficial microorganisms directly over seeds is proposed as an efficient mechanism to overcome some of these disadvantages since it facilitates colonization of microbial inocula to soil and/or plant. Thus, direct seed treatments with beneficial microorganisms helps to the plant colonization by the microbials at an early stage of development and continuing through all its life cycle. Broadly, these methods have been reported as the best alternative for the application of a wide range of beneficial microorganisms to seed. However, they were mainly described for research purposes (O'Callaghan, 2016) (and references therein). Most work on microbial seed inoculation is developed by agrichemical and seed companies and the techniques and processes used are rarely published and are held as "in house knowledge" (US2010/0154299A1; US2015/0289515 A1; US2018/0064116A1; US2018/098483A1; US2018/0064116A1; US2018/0132486A1).

The current seed treatments using PGPB as bioinoculants, include procedures such as:

Coating: precise amounts of active ingredients (bacteria, pesticides, fungicides, etc.) are applied over the seed surface using a liquid media, generating a thin layer over the seed that doesn't modify its shape. There are mainly two different types of coating: "film coating" or "slurry coating". In film coating procedures, the inoculum is applied as an aqueous cell suspension using polymers or adhesive materials (e.g. methyl cellulose, vegetable or paraffin oils, polysaccharides, etc). On the opposite, in slurry coating seed treatment methods the inoculants are formulated as dry powders or attached to specific carriers (commonly peat, charcoal, lignite, farmyard manure, etc.) and they are applied to the outside of seeds using a range of stickers. While film coating has mainly been used experimentally, the slurry coating is used extensively on farms. Although these methods have been proved to reduce reproducibility inconsistency issues in the field, problems as seed shelf-life and cell viability still persist in commercially available formulations (Calabi-Floody et al., 2018; Taylor et al., 1998; Taylor and Harman, 1990).

Pelleting: the process involves the addition of inert materials with the intention of enlarging the seed and producing a globular unit of a standard size. This procedure has gained popularity in precision agriculture, since it allows modification of the shape and size of small and irregularly seeds thus facilitates the handling by machines for precision sowing. There are two main components in a seed pelleting: the bulking-coating material and the binder. The bulking material can either be a mixture of several different mineral and/or organic substances or a single component. The second component, the binder, holds the coating material together. Many different compounds have been used as binders, including various starches, sugars, gum arabic, clay, cellulose, vinyl polymers (O'Callaghan, 2016; Taylor et al., 1998; Taylor and Harman, 1990) (and references therein).

Priming: this method comprises the immersion of seeds in an aqueous suspension (without using any kind of liquid polymer or adhesive) for a pre-determined period, followed by drying of seed to prevent onset of germination. Given the effort involved in this process, it is most appropriate for low-medium volume and high value crops, such as vegetable seeds (O'Callaghan, 2016; Taylor et al., 1998; Taylor and Harman, 1990). Among different priming techniques, hydration using any biological compound is termed as 'biopriming' (Ashraf and Foolad, 2005; Bennett and Whipps, 2008b, 2008a; Wright et al., 2003; Yadav et al., 2018)

Current Limitations for Implementation of the Microbial Technology on Seeds

A comprehensive review on microbial technologies, the formulations and practical perspectives of bioinoculants has been published (Bashan et al., 2014). The authors reported a number of top priorities for PGPB inoculants must be carefully analyzed and overcome considering: improvements in the implementation of delivery systems; in-depth evaluation of carriers, an enhancement survival of microorganisms in the inoculants, an increase in the shelf-life of the inoculant products, the use of multi-strain inoculants, to develop more low-cost technology, to practice nursery inoculation for transplanted crops, etc. More recently, the most common biopriming technologies was reviewed (O'Callaghan, 2016). Although not exhaustive, the cited work agreed in identify the key constraints limiting commercial development of microbial seed inoculants.

To date, significant technical challenges must be tackled before achieving a commercially viable seed treatment based on microbial inocula, specially 1) the effective viability of the microbial inocula on the seed throughout all the seed treatment, processing and storage stages for finally obtaining the desired PGPB effects on plants in the field after sowed, 2) the effective viability of the seed after being treated because it is a well-known fact that treated seeds with techniques based on liquid imbibition, such as hydropriming and osmopriming, presents a rapidly decrease in their storage life measured as their germination capability and vigor (Wang et al., 2018; Schwember and Bradford, 2011; Hill and Cunningham, 2007; Tarquis and Bradford, 1992), and 3) for the positive effect derived from the interaction microbial inocula with the host plant to be successfully achieved in different soil types and environmental conditions.

Biopriming and Seed Treatment Methodology: Microprime™

A typical seed priming protocol includes the steps of soaking the seeds in any solution containing a required priming agent (inorganic and organic salts, nanoparticles, plant growth regulating substances and/or plant growth promoting bacteria) followed by re-drying the seeds. This results into the start of the germination process except by the radicle emergence (Heydecker et al., 1973; Mahakham et al., 2017; McDonald, 1999; Song et al., 2017; Wright et al., 2003). Seed priming using osmotic solutions (osmopriming) has been around for many decades (Heydecker et al., 1973) and is now a common commercial practice in selected high value horticultural seeds. This concept was also extended to hydropriming in cereal and legume crops and the "on farm" priming technique has been revived (Harris et al., 2001). In recent years, several metal- and carbon-based nanoparticles (e.g., AgNPs16, AuNPs5, CuNPs17,18, ZnNPs17,18, fullerene22 and carbon23 nanotubes, etc.) have been applied as seed priming agents for promoting seed germination, seedling growth and stress tolerance in some crops (Mahakham et al., 2017). Amongst different priming techniques (e.g. hydropriming, osmopriming, nanopriming, etc.) when this procedure is performed using microbial cells, the inner spaces within a seed have potentially ideal conditions for the bacterial inoculation and colonization (McQuilken et al., 1998; Ashraf and Foolad, 2005; Bennett et al., 2009; Tabassum et al., 2018; Wright et al., 2003).

Since the early 90's the biopriming method has been extensively used for a wide range of crops and has been undoubtedly recognized as an environmentally friendly agrotechnology (O'Callaghan, 2016; Taylor and Harman, 1990). Sometimes, the biopriming technique is wrongly defined as the application of whole microorganisms, their exudates or some biologically active compounds on the outside of the seed (El-Mougy and Abdel-Kader, 2008; Müller and Berg, 2008; Song et al., 2017; Saber et al., 2012). Being more accurately, biopriming incorporates biological (inoculation of seed with beneficial microorganism) and physiological elements (seed hydration) into the seed, by promoting the rate and uniformity emergence of seedlings and also improving the plant traits. Seeds treated with microorganisms differ fundamentally from other biological seed treatments in that while performing the seed treatment with microorganisms the cells may be alive and so the colonization and proliferation of the added microbes must occur inside the seeds. However, most literature from the previous state of art, is not rigorous on explaining the differences in detail. Specifically, no results or studies have been yet reported on 1) the survival and/or proliferation of the biological agents (PGPB strains or consortia) inside the seed through relevant time frames (several months), 2) seed shelf-life and effective germination after several months after treatment, 3) effective microbe inocula and plant interaction after relevant time being the seed stored and 4) economically viable methodologies (taking into account relevant factors such as seed treatment required time, inputs and energy) with the potential of being scalable and thus being implementable within a traditional seed business model. Moreover, bio-osmopriming have solely demonstrated to significantly enhance the uniformity of the germination and plant growth traits when associated with bacterial coating procedures (Bennett et al., 2009; Raj et al., 2004; Sharifi, 2011; Sharifi et al., 2011; Shariffi et al., 2012). Several researchers have reported incubation time from 20 min to several days (Bennett et al., 2009; Bennett and Whipps, 2008b, 2008a; Murunde and Wainwright, 2018). As well, cell suspension broadly ranged from $10^5$ to $10^9$ cells per gram of seed and depending on the type of the biological agent (i.e: spores, endospore or vegetative cells) (Wright et al., 2003; Saber et al., 2012; Raj et al., 2004; Murunde and Wainwright, 2018). In fact, the biopriming has been practiced and explained by different researchers in several ways, but is still an ambiguous approach which needs to be explored and discussed (Bennett et al., 2009; Callan et al., 1990, 1991; Chakraborty et al., 2011; Mirshekari et al., 2012; Moeinzadeh et al., 2010; Raj et al., 2004; Reddy, 2013; Sharifi, 2011; Sharifi et al., 2011; Sharifi et al., 2012).

According to the state of the art, the use of *Bacillus* sp. exudates to trigger immunity on cucumber plants was explained by Song et al., (Song et al., 2017). This approach have several misleading results both in method and scope because it 1) Does not use the bacterial inocula or its derived plant growth promoting agents but instead the seed is bioprimed by a compound based on peptides; 2) Does not incorporates living microorganisms inside the seed for them or its exudates to be in contact with the embryo at early post-dormant stage of seed germination; 3) Does not confirms if the biological agent (e.g. cyclodipeptides) have entered the seed and primed a PGP effect (changes in genes expression) at early stage of the plant embryo (previous to the pericarp rupture); and 4) Does not inform on the stability of the elicitors of plant immunity triggers through time. This last issue is particularly relevant since a commercially feasible microbial technology for agriculture must have to be stable through a relatively long period of time (e.g. more than six months) in order to be compatible with current agricultural distribution systems. In addition, the biological priming agent used in this referenced work, is particularly unstable through time and susceptible to be changed by abiotic and biotic environmental factors (e.g. temperature, pH, biodegradation activity by other microorganisms, etc.).

Serratia plymuthica strain HRO-C48 was also reported as biological agent for inoculation procedures on seeds (Müller and Berg, 2008). This work attempted to compare three different techniques as pelleting, film coating and bio-osmopriming. In spite of the cells numbers per seed that was determined immediately after seed treatment and storage, authors have failure in accurately quantify the shelf-life of the product for it to be a commercially feasible for the agriculture industry. In fact, the strain HRO-C48 viability was just determined over an extremely short storage period (30 days). An additional ambiguous topic reported by the authors relies on the biopriming optimization procedures since 1) a high initial cell density was adjusted for the seed immersion and, 2) long incubation time of the seeds in the presence of the biological agent was used (reported as 12 hours). Certainly, all of this aspects are often not feasible parameters for an industrial and commercial implementation of the method (Müller and Berg, 2008).

Some other works pointing out the incorporation of synthetic microorganism formulations inside the seed were also reported in the state of the art. For instance, the US Patent 2016/0338360 A1 and 2016/0330976 A1 have referred to a seed containing beneficial bacteria. The methods presented in both of these referenced works are based on the direct inoculation of flowers and different parts of the plant in order to finally obtain seeds containing the desired microorganisms (Mitter et al, 2016a, 2016b).

The current invention proposes a new, effective and reliable alternative to traditional biopriming technology that directly tackles the previously described issues. The proposed seed treatment method, denominated Microprime™, is a well-designed, calculated, executed and controlled process for obtaining commercial seeds with improved plant traits and yield performance. Precisely, the invention relates to a stable microbial seed treatment methodology by which is incorporated a plant-beneficial bacteria and/or a synthetic consortia of microorganisms and/or its exudates and/or its individualized biomolecules inside of seeds through an industrially scalable process, which takes into account the process cost, time and energy, the technology stability through time (for both the plant embryo and the inoculant), the multi-soil compatibility, the stability under different environmental conditions and also compatibility with the traditional distribution chain for agricultural inputs. The method involves a controlled, economical and fast imbibition of seeds in an aqueous solution of an osmotically active liquid media supplemented with an specific amount of the beneficial microorganisms or a synthetic consortia of microorganisms and/or its exudates and/or its individualized biomolecules, in addition to a surfactant to enhance intra-seed permeability and/or a group of nutrients to enhance the microorganism colonization inside the seed and/or a supplemental reagent for enhancing bacterial endospore formation. The biological agent survival, the genetic modulation of the embryo and the extended shelf-life of the treated seed are guaranteed by the Microprime™ seed technology. Finally, the novel methodology reported here includes certain checkpoints along the entire process, providing a replicable and reliable final product. Some of the checkpoints include the confirmation of a molecular priming on the seed, measuring the expression of a specific set of genes related to development, abiotic stress tolerance and defense response to pathogens.

The invention proposes a novel strategy for enabling plant traits and enhance its yield. The strategy is based on two effects in the plant seed that are achieved by the implementation of a specific seed treatment method (Microprime™) explained below:

1. Loading into the seed functional bacteria: endospore-forming bacteria and/or endospores are loaded into the seed by the implementation of the current seed treatment method. As a result of the Microprime™ seed treatment, endospore-forming bacteria and/or endospores are allocated into the seed in an interspace located between the seed pericarp and its aleurone cell layer, as is shown in FIG. 1 and FIG. 4. The endospore-forming bacteria and/or endospores incorporated into the seed correspond to strains which have the ability to effectively colonize the plant rhizosphere and also have the ability to fixing nitrogen and/or solubilize phosphate and/or synthesize phytohormones. The endospore-converting ability of the selected bacteria and its allocation inside the seed guarantees the stability after the Microprime™ seed treatment and during the entire commercial storage. This process is confirmed by bacterial cell count in time (examples 1-5).

2. Plant gene expression modulation: this is achieved during the Microprime™ seed treatment process by the action of selected bacteria and/or bacteria's exudates which are able to enter into the seed and reach the embryo triggering Induced Systemic Tolerance (IST) and/or Induced Systemic Resistance (ISR) and/or plant development program. These three processes allow plants to tolerate abiotic stresses (heat, drought, salinity, etc.), resist biotic stress (pathogen attacks) and enhance root system and therefore its nutrient and water acquisition which directly improves plant performance. This effect is confirmed with transcriptional analysis by qRT-PCR of key genes involved in the mentioned process (example 11).

In order for this invention to have value and real industrial-scale applicability, it is necessary that the method to be cost efficient and scalable. In a seed treatment process like the one in this invention, there are several steps that require time, inputs and energy. The method and the invention proposed have as a first priority making the seed treatment processing cost and time as low as possible. The Microprime™ methodology aims to make the seed treatment process effective when carried out at room temperature (between 20 and 24° C.) while performing the seed imbibition during less than 20 minutes to 16 hours. The latter is not trivial to achieve, since in addition to having a minimum desirable number of bacteria, endospore-forming bacteria and/or endospores within the seeds after the Microprime™ seed treatment, it is necessary for the bacteria remain stable and viable over time, so, the seeds (as a product) can undergo unaffected through storage, packaging, logistics, and sowing processes, as is done the same with a traditional seed without Microprime™ seed treatment.

Figure 2:
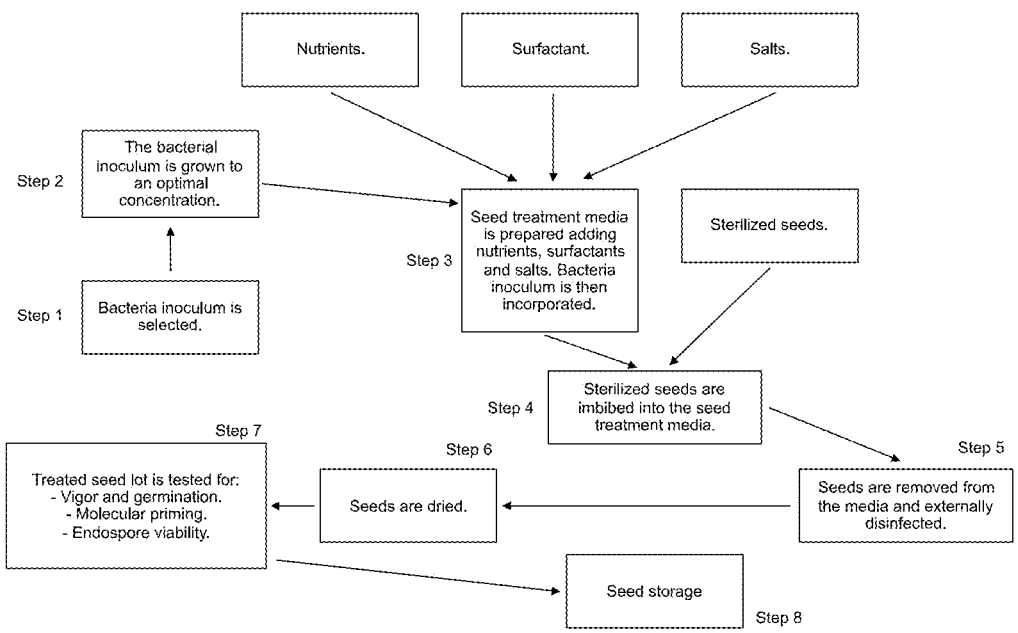
FIG. 2 shows a process diagram which depicts the seed treatment process (Microprime™ seed treatment process).

The proposed methodology consists of imbibing the previously disinfected seeds into a seed treatment media containing nutrients, surfactants and salts (henceforth micropriming solution). FIG. 2 shows a process diagram which depicts the seed treatment process.

Stability of Bacterial Seed Treatment

The stability of the bacteria within the seed over time is not a simple nor an obvious issue to address. When incorporating the bacteria into the seed using our proposed seed treatment methodology (Microprime™ seed treatment), for the case of a corn seed the place within the seed where the bacteria is located is showed in FIG. 4.

Figure 4A:
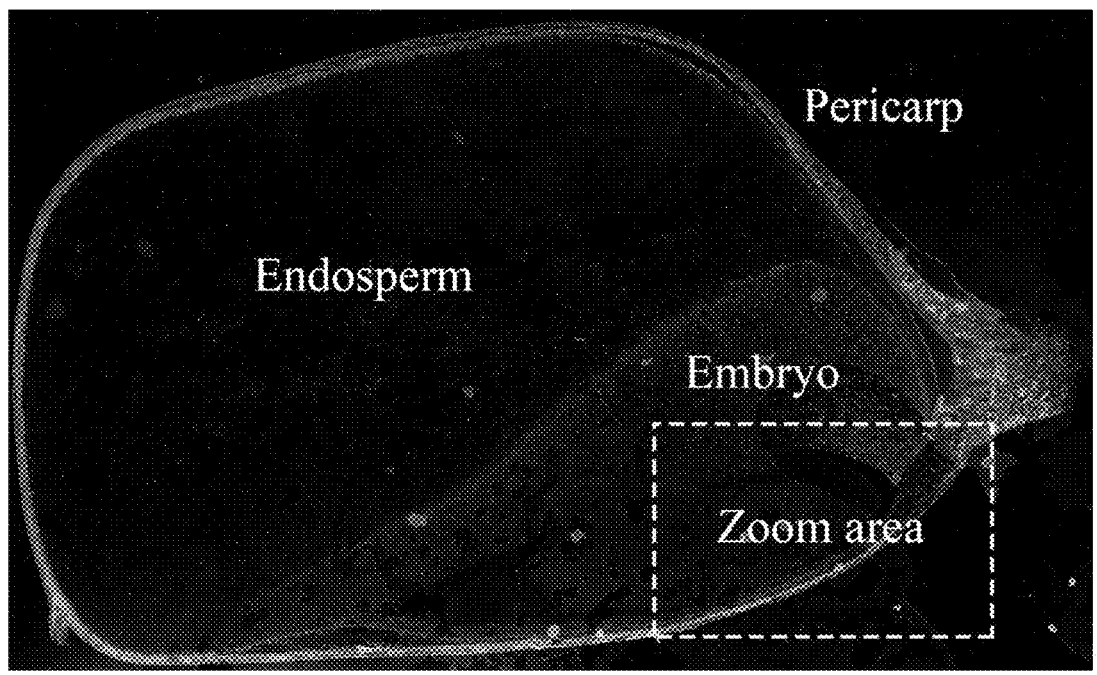
FIG. 4A shows the space inside the corn seed (*Zea mays*) where the bacteria are located after a Microprime™ seed treatment.

In FIG. 4A it can be appreciated that the space inside the corn seed where the bacteria marked with a red fluorescent protein (RFP) are lodged after the Microprime™ seed treatment (pink filaments). This place is the interspace between the seed pericarp and the seed aleurone cells layer, which separates the endosperm and embryo from outer layers. This is a place where some microorganisms can be comfortable for a limited period of time, after which due to depletion of available nutrients necessarily the cell will die or in case of some specific microorganisms, start a process of endosporulation (bacteria from the Firmicutes, Proteobacteria and Actinobacteria Phylum). The benefit of being deposited in the aforementioned place is that the microorganisms are protected from external elements that could affect their immediate integrity such as other microorganisms or dehydration.

To tackle the viability issue for longer periods of time due to the lack of nutrients, the methodology will depend on the type of bacteria to cope with it. There are bacteria that under certain conditions (mainly in scenarios where they sense feasibility risk), they have the ability to stop multiplying and enter to a physical state called endospore. As an endospore, the bacterium enters a dormant scenario in which it may be absent from nutrients for extended periods of time. For bacteria, mainly from the Firmicutes, Proteobacteria and Actinobacteria phylum, which have the capacity to generate endospores, the Microprime™ solution is supplemented with certain salts that will push the bacteria to enter this state of lethargy once it is incorporated into the seed. By doing the latter the viability of the bacteria within the seed is ensured over time. When the endospore is found again in favorable conditions of moisture and nutrients (for instance when the seed is sowed), it reverts to an active-bacteria state (vegetative cell) and starts normal functions and vegetative reproduction.

Another strategy is to supplement the Microprime™ solution directly with endospores rather than to push the bacteria to convert while performing the seed treatment process. The later had shown better yields in terms of endospores per seed that can be found after a Microprime™ seed treatment.

The following Table 1 shows some bacteria genus that are of special interest for this proposed novel seed treatment due to their ability of converting to endospores:

TABLE 1

| Phylum | Firmicutes | | | Proteobacteria | Actinobacteria |
|---|---|---|---|---|---|
| Genus | Acetonema sp. | Halonatronum sp. | Sporohalobacter sp. | Actinomyces sp. | Coxiella sp. |
| | Alkalibacillus sp. | Heliobacterium sp. | Sporolactobacillus sp. | | |
| | Ammoniphilus sp. | Heliophilum sp. | Sporomusa sp. | | |
| | Amphibacillus sp. | Laceyella sp. | Sporosarcina sp. | | |
| | Anaerobacter sp. | Lentibacillus sp. | Sporotalea sp. | | |
| | Anaerospora sp. | Lysinibacillus sp. | Sporotomaculum sp. | | |
| | Aneurinibacillus sp. | Mahella sp. | Syntrophomonas sp. | | |
| | Anoxybacillus sp. | Metabacterium sp. | Syntrophospora sp. | | |
| | Bacillus sp. | Moorella sp. | Tenuibacillus sp. | | |
| | Brevibacillus sp. | Natroniella sp. | Tepidibacter sp. | | |
| | Caldanaerobacter sp. | Oceanobacillus sp. | Terribacillus sp. | | |
| | Caloramator sp. | Orenia sp. | Thalassobacillus sp. | | |
| | Caminicella sp. | Ornithinibacillus sp. | Thermoacetogenium sp. | | |
| | Cerasibacillus sp. | Oxalophagus sp. | Thermoactinomyces sp. | | |
| | Clostridium sp. | Oxobacter sp. | Thermoalkalibacillus sp. | | |
| | Clostridiisalibacter sp. | Paenibacillus sp. | Thermoanaerobacter sp. | | |
| | Cohnella sp. | Paraliobacillus sp. | Thermoanaeromonas sp. | | |
| | Dendrosporobacter sp. | Pelospora sp. | Thermobacillus sp. | | |
| | Desulfotomaculum sp. | Pelotomaculum sp. | Thermoflavimicrobium sp. | | |
| | Desulfosporomusa sp. | Piscibacillus sp. | Thermovenabulum sp. | | |
| | Desulfosporosinus sp. | Planifilum sp. | Tuberibacillus sp. | | |
| | Desulfovirgula sp. | Pontibacillus sp. | Virgibacillus sp. | | |
| | Desulfunispora sp. | Propionispora sp. | Vulcanobacillus sp. | | |
| | Desulfurispora sp. | Salinibacillus sp. | | | |
| | Filifactor sp. | Salsuginibacillus sp. | | | |
| | Filobacillus sp. | Seinonella sp. | | | |
| | Gelria sp. | Shimazuella sp. | | | |
| | Geobacillus sp. | Sporacetigenium sp. | | | |
| | Geosporobacter sp. | Sporoanaerobacter sp. | | | |
| | Gracilibacillus sp. | Sporobacter sp. | | | |
| | Halobacillus sp. | Sporobacterium sp. | | | |

The bacteria of the genus Bacillus are one of the most abundant with endosporulation ability and also there exist extensive studies of multiple strains of Bacillus with PGPB traits. For an adequate proliferation of bacteria inside the seed, it is necessary to supplement the Microprime™ solution with nutrients of particular compatibility with the selected bacterium, or alternatively, directly eadd to the Microprime™ solution endospores of the desired bacterium to be incorporated into the seed.

Biological Priming of the Seed Embryo

The method of the disclosure contemplates treatment of plant seeds with bacterial compositions designed as previously explained (Microprime™ seed treatment). Such a treatment can employ osmotic permeation of the seeds to allow bacteria incorporation, a treatment that was described initially by Smith et al. to introduce chemical priming agents into the seeds is currently referred to as osmopriming. The method of this disclosure, however, has been adapted to the incorporation of bacterial populations into the dormant seeds, with the aim to produce an early conditioning of the emerging plantlet through direct biological priming of the embryo, once dormancy is finished, and proper environmental or agronomic conditions induce the first stage of germination. This novel approach provides an unprecedented advantage with respect to previously disclosed bacterial formulations designed to produce biological priming, since incorporated bacteria are protected within dormant seeds, and conveniently positioned to produce by themselves or by action of their exudates an enduring priming of the embryo from the earliest possible developmental stages (example 11). Furthermore, treated seeds are susceptible to regular transport, storage, coating pelleting and sowing treatments according to the standard agronomic practice, without any additional requirement regarding manipulation, nutritional additives, preservatives, or irrigation, and without incompatibility restrictions related to pest or plant disease control agents. Thus, the method described here (Microprime™ seed treatment) also provides a clear advantage from seed biopriming (Mahmood et al., 2016), because that method involves pre-germination of the seeds and dormancy termination, which reduces storage survival and limits manipulation and treatment feasibility (examples 5 and 6).

In addition, the method of this disclosure is different from methods previously reported to inoculate seeds using parental plants as reactors for microbial growth or by inoculation of plant sexual organs (Mitter et al., 2016a; Mitter et al., 2016b). Such methods imply an intrinsic bias in the type of bacteria that can be finally incorporated into the seeds, as successful inoculants must be able to survive within plant target organs or tissues, to compete with endogenous microorganisms and to access the seed inner space by their selves. The Microprime™ strategy presented here is not hampered by endophytic competence or tissue survival, as artificially incorporated bacteria do not have to be endosymbionts, they do not need to face the defensive response of a mature plant, or outcompete endophytic microbiota, but are only required to survive long enough or for its exudates to be able to reach the plant embryo to produce a molecular priming of the plant.

Figure 4B:
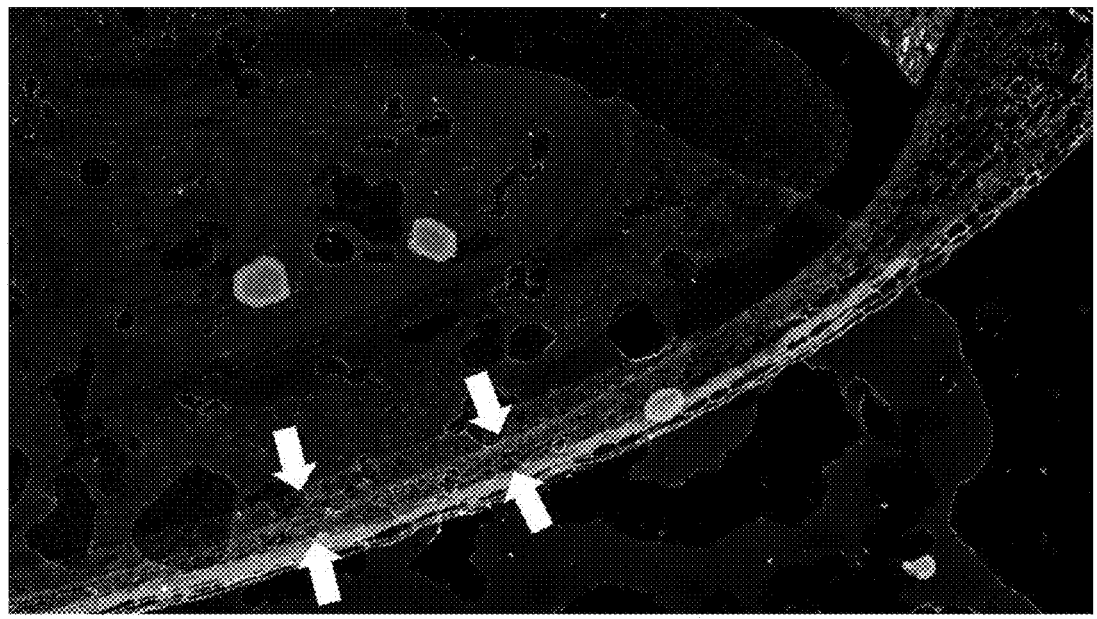
FIG. 4B shows a zoomed in image of the space inside a corn seed (*Zea mays*) where bacteria are located after a Microprime™ seed treatment.
Figure 5:
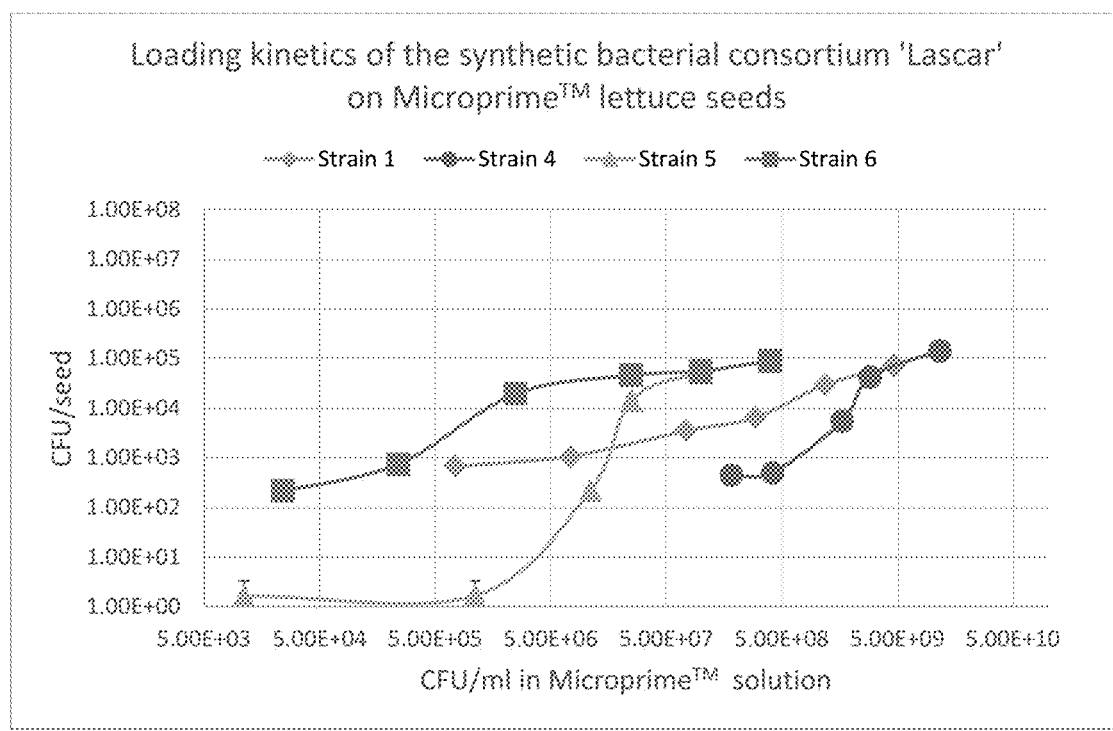
FIG. 5 shows the loading kinetics by Microprime™ seed treatment of a synthetic bacterial consortium (Lascar) into lettuce seeds (*Lactuca sativa*).

We believe that the unique advantages and differentiating features stated above make the method of this disclosure non-obvious to a person skilled in the techniques involved in bacterial plant growth stimulation. In fact, for this strategy to be successful, certain key conditions must be met by candidate bacteria for treatment compositions, which are not necessarily considered in standard formulation of plant growth-promoting microorganisms. In the first place, bacterial compositions must be designed using the effectiveness and compatibility criteria described above, to avoid competition and/or antagonistic effects within the seeds. Absence of these effects must be experimentally assessed before a composition is formulated. Seed internalization must be evaluated for each bacterium contained in a designed composition, determining saturation curves, and bacterial survival during storage time and seed treatment procedures (FIG. 5, examples 1-5). Furthermore, analyses of the seed internal tissues must also be carried out to assess the presence and viability of the desired bacteria and the relative abundance of each component strain with respect to others (FIG. 4, examples 1-5).

Plant material must also be conditioned prior to treatment with a specific bacterial composition. Seeds may be sterilized in order to eliminate any background noise while determining the effectiveness of the Microprime™ seed treatment.

Once Microprime™ has occurred, transcriptional analysis of marker genes related to defense among pathogens, abiotic stress tolerance and development must be determined to confirm the impact of the beneficial bacteria on the treated seeds (example 11). This analysis must be performed after the dormancy stage of the seed and previous to the seed pericarp and endosperm rupture and radicle emergence. Assessment of transcriptional changes in the developing embryo that are due to previous bacterial treatment of the dormant seed is also a crucial step in the validation of the methodology, since it provides a fast confirmation of priming effectiveness, and the results cannot yet be influenced by external factors that appear after seed rupture, including access to other microorganisms from the seed exterior to the developing plant tissue and/or the chemical composition of the surrounding soil or growth substrate.

The methods and compositions proposed in this invention can be summarized on Microprime™ seed treatment method where seeds are incorporated into a saline solution containing seed-compatible bacteria compositions, bacteria-compatible nutrients (in case of using non-endosporulating bacteria), and surfactants to increase bacterial cell load into de seed at room temperature and in a short period of seed immersion and the supplemented minerals for increasing the conversion rate of endospore-forming bacteria to endospores (FIG. 2).

Figure 3:
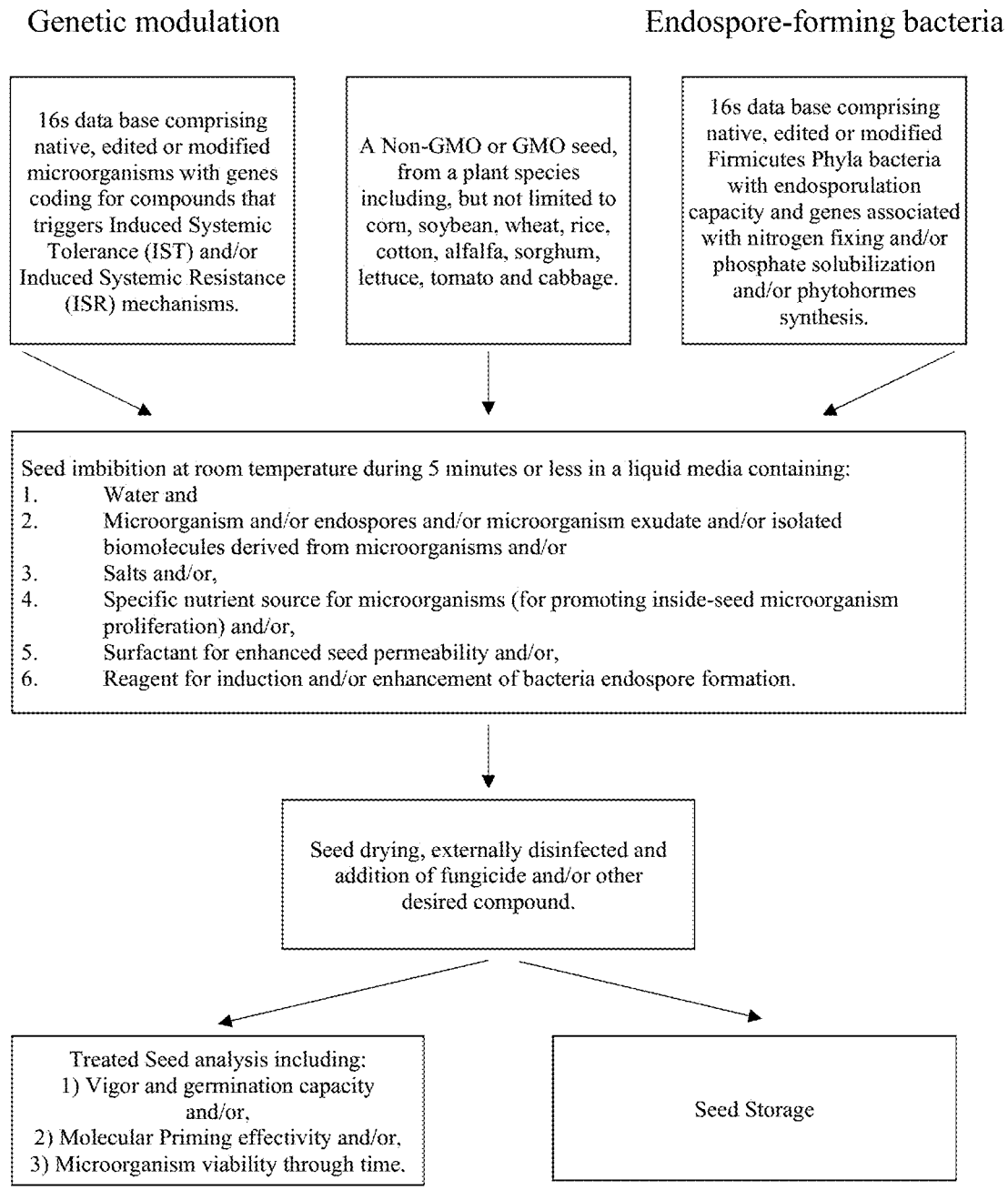
FIG. 3 depicts the present invention methodology for obtaining stable microbial technology seed treatments (Microprime™).

FIG. 3 depicts the present invention methodology for obtaining stable microbial technology seed treatments.

Modified Plant Seeds

In one aspect, provided herein, is a modified plant seed comprising a microorganism or an exudate of a microorganism incorporated into the seed. In some embodiments, the microorganism or exudate imparts a beneficial property to the plant. In some embodiments, the beneficial property improves plant growth. In some embodiments, the beneficial property is improved plant growth. In some preferred embodiments, the microorganism is an endospore forming bacteria or endospore thereof.

The microorganism or exudate incorporated into a modified plant seed may improve a variety of plant properties that promote plant growth. In some embodiments, the microorganism or exudate imparts a plant growth effect. In some embodiments, the plant growth effect comprises cell osmoregulation, ionic homeostasis, antioxidant defense, heat stress tolerance, maintenance of photosynthetic capacity, or a combination thereof. In some embodiments, the plant growth effect comprises cell osmoregulation. In some embodiments, the plant growth effect comprises ionic homeostasis. In some embodiments, the plant growth effect comprises antioxidant defense. In some embodiments, the plant growth effect comprises heat stress tolerance. In some embodiments, the plant growth effect comprises maintenance of photosynthetic capacity. In some embodiments, the plant growth effect is triggering Induced Systemic Resistance. In some embodiments, the plant growth effect is triggering Induced Systemic Tolerance.

In some embodiments, the microorganism or exudate incorporated into the seed improves seed germination rate. In some embodiments, the seed germination rate is improved by at least about 1%, at least about 2%, at least about 3%, at least about 4%, at least about 5%, at least about 10%, at least about 20%, at least about 30%, at least about 40%, or at least about 50%. In some embodiments, the seed germination rate is improved by at least about 1%. In some embodiments, the seed germination rate is improved by at least about 2% In some embodiments, the seed germination rate is improved by at least about 3%. In some embodiments, the seed germination rate is improved by at least about 4%. In some embodiments, the seed germination rate is improved by at least about 5%. In some embodiments, the seed germination rate is improved by at least about 10%. In some embodiments, the seed germination rate is improved by at least about 20%. In some embodiments, the seed germination rate is improved by at least about 30%. In some embodiments, the seed germination rate is improved by comparison to a seed that has not had the microorganism or exudate incorporated into the seed.

In some embodiments, the microorganism or exudate incorporated in the seed improve plant growth in stress conditions. In some embodiments, the microorganism or exudate incorporated into the seed improves drought tolerance. In some embodiments, the improved drought tolerance is the ability to grow in times of drought. In some embodiments, the plant growth is improved during times of drought compared to plants grown from seeds without the microorganism or exudate incorporated. In some embodiments, the plant growth is improved by at least about 1%, at least about 2%, at least about 3%, at least about 4%, at least about 5%, at least about 10%, at least about 20%, at least about 30%, at least about 40%, or at least about 50% in conditions of drought.

In some embodiments, plant growth is improved by about 1% to about 50%. In some embodiments, plant growth is improved by about 1% to about 2%, about 1% to about 3%, about 1% to about 4%, about 1% to about 5%, about 1% to about 10%, about 1% to about 20%, about 1% to about 30%, about 1% to about 40%, about 1% to about 50%, about 2% to about 3%, about 2% to about 4%, about 2% to about 5%, about 2% to about 10%, about 2% to about 20%, about 2% to about 30%, about 2% to about 40%, about 2% to about 50%, about 3% to about 4%, about 3% to about 5%, about 3% to about 10%, about 3% to about 20%, about 3% to about 30%, about 3% to about 40%, about 3% to about 50%, about 4% to about 5%, about 4% to about 10%, about 4% to about 20%, about 4% to about 30%, about 4% to about 40%, about 4% to about 50%, about 5% to about 10%, about 5% to about 20%, about 5% to about 30%, about 5% to about 40%, about 5% to about 50%, about 10% to about 20%, about 10% to about 30%, about 10% to about 40%, about 10% to about 50%, about 20% to about 30%, about 20% to about 40%, about 20% to about 50%, about 30% to about 40%, about 30% to about 50%, or about 40% to about 50%. In some embodiments, plant growth is improved by about 1%, about 2%, about 3%, about 4%, about 5%, about 10%, about 20%, about 30%, about 40%, or about 50%. In some embodiments, plant growth is improved by at least about 1%, about 2%, about 3%, about 4%, about 5%, about 10%, about 20%, about 30%, or about 40%. In some embodiments, plant growth is improved by at most about 2%, about 3%, about 4%, about 5%, about 10%, about 20%, about 30%, about 40%, or about 50%. In some embodiments, plant growth is measured by comparison to a plant grown from a seed untreated with the microorganism or exudate.

The plant growth may be measured by measuring the size of a portion of the plant. The portion of the plant may depend upon the type of plant. For example, when the plant seed is a lettuce plant seed (ex. *Lactuca sativa*), the size of the rosette may be measured. In some embodiments, the size of the fruit is used to measure plant growth. In some embodiments, the weight of the shoot of the plant is used to measure plant growth. In some embodiments, the weight of the root of the plant is used to measure plant growth. In some embodiments, the plant or the part of the plant is dried before measurement.

In some embodiments, the plant growth is measured after a desired period of time. In some embodiments, plant growth is measured after about 1 week to about 36 weeks. In some embodiments, plant growth is measured after about 1 week to about 2 weeks, about 1 week to about 4 weeks, about 1 week to about 6 weeks, about 1 week to about 8 weeks, about 1 week to about 12 weeks, about 1 week to about 18 weeks, about 1 week to about 36 weeks, about 2 weeks to about 4 weeks, about 2 weeks to about 6 weeks, about 2 weeks to about 8 weeks, about 2 weeks to about 12 weeks, about 2 weeks to about 18 weeks, about 2 weeks to about 36 weeks, about 4 weeks to about 6 weeks, about 4 weeks to about 8 weeks, about 4 weeks to about 12 weeks, about 4 weeks to about 18 weeks, about 4 weeks to about 36 weeks, about 6 weeks to about 8 weeks, about 6 weeks to about 12 weeks, about 6 weeks to about 18 weeks, about 6 weeks to about 36 weeks, about 8 weeks to about 12 weeks, about 8 weeks to about 18 weeks, about 8 weeks to about 36 weeks, about 12 weeks to about 18 weeks, about 12 weeks to about 36 weeks, or about 18 weeks to about 36 weeks. In some embodiments, plant growth is measured after about 1 week, about 2 weeks, about 4 weeks, about 6 weeks, about 8 weeks, about 12 weeks, about 18 weeks, or about 36 weeks. In some embodiments, plant growth is measured after at least about 1 week, about 2 weeks, about 4 weeks, about 6 weeks, about 8 weeks, about 12 weeks, or about 18 weeks. In some embodiments, plant growth is measured after at most about 2 weeks, about 4 weeks, about 6 weeks, about 8 weeks, about 12 weeks, about 18 weeks, or about 36 weeks. In some embodiments, plant growth is measured after about 7 days to about 42 days. In some embodiments, plant growth is measured after about 7 days to about 14 days, about 7 days to about 28 days, about 7 days to about 42 days, about 14 days to about 28 days, about 14 days to about 42 days, or about 28 days to about 42 days. In some embodiments, plant growth is measured after about 7 days, about 14 days, about 28 days, or about 42 days. In some embodiments, plant growth is measured after at least about 7 days, about 14 days, or about 28 days. In some embodiments, plant growth is measured after at most about 14 days, about 28 days, or about 42 days.

In some embodiments, the microorganism or exudate is incorporated into the interior of the seed. In some embodiments, the microorganism or exudate is incorporated into the seed beneath the pericarp. In some embodiments, the microorganism or exudate is incorporated into the seed between the pericarp and the aleurone cell layer. In some embodiments, the microorganism or exudate contacts the embryo of the seed. In some embodiments, the microorganism or exudate does not contact the embryo of the seed. In some embodiments, the microorganism or exudate contacts the endosperm of the seed. In some embodiments, the microorganism or exudate does not contact the endosperm of the seed. In some embodiments, the microorganism or exudate is incorporated into the seed in an interspace between a seed coat and a seed embryo. In some embodiments, the microorganism or exudate is incorporated into an interspace between a seed pericarp and a seed aleurone cell layer.

The modified plant seed may be any type of plant seed. In some embodiments, the modified seed is a monocot seed. In some embodiments, the plant seed is a maize, a wheat, a rice, a barley, a rye, a sugar cane, a millet, an oat, or a sorghum seed. In some embodiments, the plant seed is a maize seed. In some embodiments, the plant seed is a *Zea maize* seed. In some embodiments, the modified seed is a dicot seed. In some embodiments, the seed is a a soybean, cotton, alfalfa, bean, quinoa, lentil, peanut, lettuce, tomato, or cabbage seed. In some embodiments, the seed is a lettuce seed. In some embodiments, the seed is a *Lactuca sativa* seed. In some embodiments, the seed is a tomato seed. In some embodiments, the seed is a *Solanum lycopersicum* seed. In some embodiments, the seed is a genetically modified organism (GMO) seed. In some embodiments, the seed is a non-GMO seed.

An amount of microorganism or exudate incorporated into the seed must be of a sufficient level in order for the plant growth effect to be imparted to the plant. In some embodiments, the amount of microorganism incorporated into the seed is about 250 colony forming units (CFU) to about 5,000 CFU. In some embodiments, the amount of microorganism incorporated into the seed is about 250 CFU to about 500 CFU, about 250 CFU to about 750 CFU, about 250 CFU to about 1,000 CFU, about 250 CFU to about 2,000 CFU, about 250 CFU to about 3,000 CFU, about 250 CFU to about 4,000 CFU, about 250 CFU to about 5,000 CFU, about 500 CFU to about 750 CFU, about 500 CFU to about 1,000 CFU, about 500 CFU to about 2,000 CFU, about 500 CFU to about 3,000 CFU, about 500 CFU to about 4,000 CFU, about 500 CFU to about 5,000 CFU, about 750 CFU to about 1,000 CFU, about 750 CFU to about 2,000 CFU, about 750 CFU to about 3,000 CFU, about 750 CFU to about 4,000 CFU, about 750 CFU to about 5,000 CFU, about 1,000 CFU to about 2,000 CFU, about 1,000 CFU to about 3,000 CFU, about 1,000 CFU to about 4,000 CFU, about 1,000 CFU to about 5,000 CFU, about 2,000 CFU to about 3,000 CFU, about 2,000 CFU to about 4,000 CFU, about 2,000 CFU to about 5,000 CFU, about 3,000 CFU to about 4,000 CFU, about 3,000 CFU to about 5,000 CFU, or about 4,000 CFU to about 5,000 CFU. In some embodiments, the amount of microorganism incorporated into the seed is about 250 CFU, about 500 CFU, about 750 CFU, about 1,000 CFU, about 2,000 CFU, about 3,000 CFU, about 4,000 CFU, or about 5,000 CFU. In some embodiments, the amount of microorganism incorporated into the seed is at least about 250 CFU, about 500 CFU, about 750 CFU, about 1,000 CFU, about 2,000 CFU, about 3,000 CFU, or about 4,000 CFU. In some embodiments, the amount of microorganism incorporated into the seed is at most about 500 CFU, about 750 CFU, about 1,000 CFU, about 2,000 CFU, about 3,000 CFU, about 4,000 CFU, or about 5,000 CFU. In some embodiments, at least about 500 CFU are incorporated into the seed. In some embodiments, at least about 1000 CFU are incorporated into the seed.

In some embodiments, the microorganism or exudate incorporated into the seed is shelf stable for an extended period of time. In some embodiments, the shelf stability indicates that the plant growth promoting effect of the incorporated microorganism or exudate persists for the extended period of time. In some embodiments, the modified seed is shelf stable for about 3 months to about 36 months. In some embodiments, the modified seed is shelf stable for about 3 months to about 6 months, about 3 months to about 9 months, about 3 months to about 12 months, about 3 months to about 15 months, about 3 months to about 18 months, about 3 months to about 21 months, about 3 months to about 24 months, about 3 months to about 30 months, about 3 months to about 36 months, about 6 months to about 9 months, about 6 months to about 12 months, about 6 months to about 15 months, about 6 months to about 18 months, about 6 months to about 21 months, about 6 months to about 24 months, about 6 months to about 30 months, about 6 months to about 36 months, about 9 months to about 12 months, about 9 months to about 15 months, about 9 months to about 18 months, about 9 months to about 21 months, about 9 months to about 24 months, about 9 months to about 30 months, about 9 months to about 36 months, about 12 months to about 15 months, about 12 months to about 18 months, about 12 months to about 21 months, about 12 months to about 24 months, about 12 months to about 30 months, about 12 months to about 36 months, about 15 months to about 18 months, about 15 months to about 21 months, about 15 months to about 24 months, about 15 months to about 30 months, about 15 months to about 36 months, about 18 months to about 21 months, about 18 months to about 24 months, about 18 months to about 30 months, about 18 months to about 36 months, about 21 months to about 24 months, about 21 months to about 30 months, about 21 months to about 36 months, about 24 months to about 30 months, about 24 months to about 36 months, or about 30 months to about 36 months. In some embodiments, the modified seed is shelf stable for about 3 months, about 6 months, about 9 months, about 12 months, about 15 months, about 18 months, about 21 months, about 24 months, about 30 months, or about 36 months. In some embodiments, the modified seed is shelf stable for at least about 3 months, about 6 months, about 9 months, about 12 months, about 15 months, about 18 months, about 21 months, about 24 months, or about 30 months. In some embodiments, the modified seed is shelf stable for at most about 6 months, about 9 months, about 12 months, about 15 months, about 18 months, about 21 months, about 24 months, about 30 months, or about 36 months.

In some embodiments, a microorganism incorporated into a seed is stable after incorporation. In some embodiments, the microorganism is stable for greater than 30 days, for greater than six months, greater than one year, or greater than two years. In some embodiments, the microorganism is stable for greater than 30 days. In some embodiments, the microorganism is stable for greater than six months. In some embodiments, the microorganism is stable for greater than one year. In some embodiments, the microorganism is stable for greater than two years The microorganism or exudate thereof incorporated into plant seeds may be any of the microorganisms provided herein, or any other microorganism. In some embodiments, the microorganism is a microbe. In some embodiments, the microorganism is an endospore forming microbe. In some embodiments, the microorganism is an endospore forming microbe or an endospore thereof. In some embodiments, the microorganism is an endospore of a microorganism provided herein. In some embodiments, the microorganism is an endospore forming bacteria or an endospore thereof.

Methods of Incorporating Bacteria

In one aspect, provided herein, is a method of incorporating one or more microorganisms or exudates thereof into one or more plant seeds. In some embodiments, the method comprises disinfecting the plant seeds. In some embodiments, the method comprises contacting the seeds with a solution comprising the one or more microbes or the exudate thereof. In some embodiments, the solution further comprises a salt. In some embodiments, the method comprises incubating the seeds with the solution for a period of time. In some embodiments, the period of time is sufficient to allow a desired amount of microorganisms or exudates thereof into the plant seeds. In some embodiments, the method incorporates a desired amount of microorganisms or exudate thereof into the seeds.

In some embodiments, the method comprises contacting the seeds with a solution comprising a salt. Any salt may be used. In some preferred embodiments, the salt is NaCl. In some embodiments, the salt is NaCl, LiCl, KCl, $MgCl_2$, CaCl$_2$, NaBr, LiBr, KBr, MgBr$_2$, CaBr$_2$, NaI, LiI, KI, MgI$_2$, or CaI$_2$. In some embodiments, the salt comprises sodium, lithium, or potassium ions. In some embodiments, the salt comprises alkali metal ions. In some embodiments, the salt comprises alkaline earth metal ions. In some embodiments, the salt comprises halide ions. In some embodiments, the salt is an alkali or alkaline earth halide salt. In some embodiments, the salt comprises chloride, bromide, or iodide ions. In some embodiments, the salt is a sulfate, phosphate, carbonate, or nitrate salt.

The salt may be present in the solution at any suitable concentration. In some embodiments, the solution comprises about 0.85% salt (w/v). In some embodiments, the solution comprises about 0.1% to about 1.25% salt (w/v). In some embodiments, the solution comprises about 0.1% to about 2.0% salt (w/v). In some embodiments, the solution comprises about 0.1% to about 0.25%, about 0.1% to about 0.5%, about 0.1% to about 0.6%, about 0.1% to about 0.7%, about 0.1% to about 0.75%, about 0.1% to about 0.8%, about 0.1% to about 0.85%, about 0.1% to about 0.9%, about 0.1% to about 0.95%, about 0.1% to about 1%, about 0.1% to about 1.25%, about 0.25% to about 0.5%, about 0.25% to about 0.6%, about 0.25% to about 0.7%, about 0.25% to about 0.75%, about 0.25% to about 0.8%, about 0.25% to about 0.85%, about 0.25% to about 0.9%, about 0.25% to about 0.95%, about 0.25% to about 1%, about 0.25% to about 1.25%, about 0.5% to about 0.6%, about 0.5% to about 0.7%, about 0.5% to about 0.75%, about 0.5% to about 0.8%, about 0.5% to about 0.85%, about 0.5% to about 0.9%, about 0.5% to about 0.95%, about 0.5% to about 1%, about 0.5% to about 1.25%, about 0.6% to about 0.7%, about 0.6% to about 0.75%, about 0.6% to about 0.8%, about 0.6% to about 0.85%, about 0.6% to about 0.9%, about 0.6% to about 0.95%, about 0.6% to about 1%, about 0.6% to about 1.25%, about 0.7% to about 0.75%, about 0.7% to about 0.8%, about 0.7% to about 0.85%, about 0.7% to about 0.9%, about 0.7% to about 0.95%, about 0.7% to about 1%, about 0.7% to about 1.25%, about 0.75% to about 0.8%, about 0.75% to about 0.85%, about 0.75% to about 0.9%, about 0.75% to about 0.95%, about 0.75% to about 1%, about 0.75% to about 1.25%, about 0.8% to about 0.85%, about 0.8% to about 0.9%, about 0.8% to about 0.95%, about 0.8% to about 1%, about 0.8% to about 1.25%, about 0.85% to about 0.9%, about 0.85% to about 0.95%, about 0.85% to about 1%, about 0.85% to about 1.25%, about 0.9% to about 0.95%, about 0.9% to about 1%, about 0.9% to about 1.25%, about 0.95% to about 1%, about 0.95% to about 1.25%, or about 1% to about 1.25% salt (w/v). In some embodiments, the solution comprises about 0.1%, about 0.25%, about 0.5%, about 0.6%, about 0.7%, about 0.75%, about 0.8%, about 0.85%, about 0.9%, about 0.95%, about 1%, or about 1.25% salt (w/v). In some embodiments, the solution comprises at least about 0.1%, about 0.25%, about 0.5%, about 0.6%, about 0.7%, about 0.75%, about 0.8%, about 0.85%, about 0.9%, about 0.95%, or about 1% salt (w/v). In some embodiments, the solution comprises at most about 0.25%, about 0.5%, about 0.6%, about 0.7%, about 0.75%, about 0.8%, about 0.85%, about 0.9%, about 0.95%, about 1%, or about 1.25% salt (w/v). In some embodiments, the solution comprises about 0.85% salt (w/v). In some embodiments, the solution comprises from about 0.8% to about 0.9% salt (w/v). In some embodiments, the solution comprises from about 0.75% to about 0.95% salt (w/v). In some embodiments, the solution comprises from about 0.7% to about 1% salt (w/v). In some embodiments, the solution comprises from about 0.5% to about 1.25% salt (w/v). In some embodiments, the solution comprises from about 0.5% to about 2% salt (w/v). In some embodiments, the solution comprises 0.1-0.2%, 0.2-0.3%, 0.3-0.4%, 0.4-0.5%, 0.5-0.6%, 0.6-0.7%, 0.7-0.8%, 0.8-0.9%, 0.9-1.0%, 1.0-1.1%, 1.1-1.2%, 1.2-1.3%, 1.3-1.4%, or 1.4-1.5% salt (w/v).

In some embodiments, the solution comprises an additional additive. In some embodiments, the solution comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (e.g. Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof. In some embodiments, the solution comprises polyethylene glycol monolaurate (e.g. Tween 20), Poloxamer 188, Poloxamer 237, Poloxamer 338, Poloxamer 407, or a combination thereof. In some embodiments, the solution comprises a Poloxamer. In some embodiments, the solution comprises polyethylene glycol monolaurate (e.g. Tween 20). The additional additive may be present at any concentration. In some embodiments, the additional additive comprises up to about 0.01%, 0.05%, 0.1%, 0.125%, 0.15%, 0.2%, 0.5% or 1% (v/v) of the solution. In some embodiments, the additional additive comprises about 0.01% to about 1% (v/v) of the solution. In some embodiments, the additional additive comprises about 0.1% (v/v) of the solution.

In some embodiments, the solution comprises an additional metal ion. In some embodiments, the solution comprises magnesium, calcium, manganese, or any combination thereof. In some embodiments, the solution comprises magnesium. In some embodiments, the solution comprises calcium. In some embodiments, the solution comprises manganese. In some embodiments, the solution comprises magnesium and calcium. In some embodiments, the solution comprises magnesium and manganese. In some embodiments, the solution comprises calcium and manganese. In some embodiments, the solution comprises magnesium, calcium, and managanese.

In some embodiments, the solution comprises one or more nutrients for the microorganisms. In some embodiments, the solution comprises a bacterial growth media. In some embodiments, the solution comprises lysogeny broth (LB), nutrient broth, or a combination thereof. In some embodiments, the solution comprises lysogeny broth. In some embodiments, the solution comprises nutrient broth.

In some embodiments, the solution comprises a microorganism. In some embodiments, solution comprises from about $10^3$ to about $10^{17}$ colony forming units (CFU)/mL of the microorganism. In some embodiments, the solution comprises about $10^3$ to about $10^4$, about $10^3$ to about $10^5$, about $10^3$ to about $10^6$, about $10^3$ to about $10^7$, about $10^3$ to about $10^8$, about $10^3$ to about $10^9$, about $10^3$ to about $10^{10}$, about $10^3$ to about $10^{12}$, about $10^3$ to about $10^{15}$, about $10^3$ to about $10^{17}$, about $10^4$ to about $10^5$, about $10^4$ to about $10^6$, about $10^4$ to about $10^7$, about $10^4$ to about $10^8$, about $10^4$ to about $10^9$, about $10^4$ to about $10^{10}$, about $10^4$ to about $10^{12}$, about $10^4$ to about $10^{15}$, about $10^4$ to about $10^{17}$, about $10^5$ to about $10^6$, about $10^5$ to about $10^7$, about $10^5$ to about $10^8$, about $10^5$ to about $10^9$, about $10^5$ to about $10^{10}$, about $10^5$ to about $10^{12}$, about $10^5$ to about $10^{15}$, about $10^5$ to about $10^{17}$, about $10^6$ to about $10^7$, about $10^6$ to about $10^8$, about $10^6$ to about $10^9$, about $10^6$ to about $10^{10}$, about $10^6$ to about $10^{12}$, about $10^6$ to about $10^{15}$, about $10^6$ to about $10^{17}$, about $10^7$ to about $10^8$, about $10^7$ to about $10^9$, about $10^7$ to about $10^{10}$, about $10^7$ to about $10^{12}$, about $10^7$ to about $10^{15}$, about $10^7$ to about $10^{17}$, about $10^8$ to about $10^9$, about $10^8$ to about $10^{10}$, about $10^8$ to about $10^{12}$, about $10^8$ to about $10^{15}$, about $10^8$ to about $10^{17}$, about $10^9$ to about $10^{10}$, about $10^9$ to about $10^{12}$, about $10^9$ to about $10^{15}$, about $10^9$ to about $10^{17}$, about $10^{10}$ to about $10^{12}$, about $10^{10}$ to about $10^{15}$, about $10^{10}$ to about $10^{17}$, about $10^{12}$ to about $10^{15}$, about $10^{12}$ to about $10^{17}$, or about $10^{15}$ to about $10^{17}$ CFU/mL of the microorganism. In some embodiments, the solution comprises about $10^3$, about $10^4$, about $10^5$, about $10^6$, about $10^7$, about $10^8$, about $10^9$, about $10^{10}$, about $10^{12}$, about $10^{15}$, or about $10^{17}$ CFU/mL of the microorganism. In some embodiments, the solution comprises at least about $10^3$, about $10^4$, about $10^5$, about $10^6$, about $10^7$, about $10^8$, about $10^9$, about $10^{10}$, about $10^{12}$, or about $10^{15}$ CFU/mL of the microorganism. In some embodiments, the solution comprises at most about $10^4$, about $10^5$, about $10^6$, about $10^7$, about $10^8$, about $10^9$, about $10^{10}$, about $10^{12}$, about $10^{15}$, or about $10^{17}$ CFU/mL of the microorganism. In some embodiments, the solution comprises at least about $10^6$ to $10^7$ CFU/mL of the microorganism. In some embodiments, the solution comprises $1 \times 10^3$ to $1 \times 10^4$ CFU/mL; $1 \times 10^4$ to $1 \times 10^5$ CFU/mL; $1 \times 10^5$ to $1 \times 10^6$ CFU/mL; $1 \times 10^6$ to $1 \times 10^7$ CFU/mL; $1 \times 10^7$ to $1 \times 10^8$ CFU/mL; $1 \times 10^8$ to $1 \times 10^9$ CFU/mL; $1 \times 10^9$ to $1 \times 10^{10}$ CFU/mL; $1 \times 10^{10}$ to $1 \times 10^{11}$ CFU/mL; $1 \times 10^{11}$ to $1 \times 10^{12}$ CFU/mL; $1 \times 10^{12}$ to $1 \times 10^{13}$ CFU/mL; $1 \times 10^{13}$ to $1 \times 10^{14}$ CFU/mL; $1 \times 10^{14}$ to $1 \times 10^{15}$ CFU/mL; $1 \times 10^{15}$ to $1 \times 10^{16}$ CFU/mL; or $1 \times 10^{16}$ to $1 \times 10^{17}$ CFU/mL of the microorganism.

In some embodiments, the solution comprises a desired amount of microorganism per seed mass. In some embodiments, solution comprises from about $10^3$ to about $10^{17}$ colony forming units (CFU)/gram of seed. In some embodiments, the solution comprises about $10^3$ to about $10^4$, about $10^3$ to about $10^5$, about $10^3$ to about $10^6$, about $10^3$ to about $10^7$, about $10^3$ to about $10^8$, about $10^3$ to about $10^9$, about $10^3$ to about $10^{10}$, about $10^3$ to about $10^{12}$, about $10^3$ to about $10^{15}$, about $10^3$ to about $10^{17}$, about $10^4$ to about $10^5$, about $10^4$ to about $10^6$, about $10^4$ to about $10^7$, about $10^4$ to about $10^8$, about $10^4$ to about $10^9$, about $10^4$ to about $10^{10}$, about $10^4$ to about $10^{12}$, about $10^4$ to about $10^{15}$, about $10^4$ to about $10^{17}$, about $10^5$ to about $10^6$, about $10^5$ to about $10^7$, about $10^5$ to about $10^8$, about $10^5$ to about $10^9$, about $10^5$ to about $10^{10}$, about $10^5$ to about $10^{12}$, about $10^5$ to about $10^{15}$, about $10^5$ to about $10^{17}$, about $10^6$ to about $10^7$, about $10^6$ to about $10^8$, about $10^6$ to about $10^9$, about $10^6$ to about $10^{10}$, about $10^6$ to about $10^{12}$, about $10^6$ to about $10^{15}$, about $10^6$ to about $10^{17}$, about $10^7$ to about $10^8$, about $10^7$ to about $10^9$, about $10^7$ to about $10^{10}$, about $10^7$ to about $10^{12}$, about $10^7$ to about $10^{15}$, about $10^7$ to about $10^{17}$, about $10^8$ to about $10^9$, about $10^8$ to about $10^{10}$, about $10^8$ to about $10^{12}$, about $10^8$ to about $10^{15}$, about $10^8$ to about $10^{17}$, about $10^9$ to about $10^{10}$, about $10^9$ to about $10^{12}$, about $10^9$ to about $10^{15}$, about $10^9$ to about $10^{17}$, about $10^{10}$ to about $10^{12}$, about $10^{10}$ to about $10^{15}$, about $10^{10}$ to about $10^{17}$, about $10^{12}$ to about $10^{15}$, about $10^{12}$ to about $10^{17}$, or about $10^{15}$ to about $10^{17}$ CFU/gram of seed. In some embodiments, the solution comprises about $10^3$, about $10^4$, about $10^5$, about $10^6$, about $10^7$, about $10^8$, about $10^9$, about $10^{10}$, about $10^{12}$, about $10^{15}$, or about $10^{17}$ CFU/gram of seed. In some embodiments, the solution comprises at least about $10^3$, about $10^4$, about $10^5$, about $10^6$, about $10^7$, about $10^8$, about $10^9$, about $10^{10}$, about $10^{12}$, or about $10^{15}$ CFU/gram of seed. In some embodiments, the solution comprises at most about $10^4$, about $10^5$, about $10^6$, about $10^7$, about $10^8$, about $10^9$, about $10^{10}$, about $10^{12}$, about $10^{15}$, or about $10^{17}$ CFU/gram of seed. In some embodiments, the solution comprises less than $10^{10}$ CFU/gram of seed. In some embodiments, the solution comprises less than $10^9$ CFU/gram of seed. In some embodiments, the solution comprises less than $10^8$ CFU/gram of seed. In some embodiments, the solution comprises less than $10^{11}$ CFU/gram of seed. In some embodiments, the solution comprises about $10^5$ to about $10^9$ CFU/gram of seed.

In some embodiments, solution comprises from about $10^3$ to about $10^{17}$ colony cells/gram of seed. In some embodiments, the solution comprises about $10^3$ to about $10^4$, about $10^3$ to about $10^5$, about $10^3$ to about $10^6$, about $10^3$ to about $10^7$, about $10^3$ to about $10^8$, about $10^3$ to about $10^9$, about $10^3$ to about $10^{10}$, about $10^3$ to about $10^{12}$, about $10^3$ to about $10^{15}$, about $10^3$ to about $10^{17}$, about $10^4$ to about $10^5$, about $10^4$ to about $10^6$, about $10^4$ to about $10^7$, about $10^4$ to about $10^8$, about $10^4$ to about $10^9$, about $10^4$ to about $10^{10}$, about $10^4$ to about $10^{12}$, about $10^4$ to about $10^{15}$, about $10^4$ to about $10^{17}$, about $10^5$ to about $10^6$, about $10^5$ to about $10^7$, about $10^5$ to about $10^8$, about $10^5$ to about $10^9$, about $10^5$ to about $10^{10}$, about $10^5$ to about $10^{12}$, about $10^5$ to about $10^{15}$, about $10^5$ to about $10^{17}$, about $10^6$ to about $10^7$, about $10^6$ to about $10^8$, about $10^6$ to about $10^9$, about $10^6$ to about $10^{10}$, about $10^6$ to about $10^{12}$, about $10^6$ to about $10^{15}$, about $10^6$ to about $10^{17}$, about $10^7$ to about $10^8$, about $10^7$ to about $10^9$, about $10^7$ to about $10^{10}$, about $10^7$ to about $10^{12}$, about $10^7$ to about $10^{15}$, about $10^7$ to about $10^{17}$, about $10^8$ to about $10^9$, about $10^8$ to about $10^{10}$, about $10^8$ to about $10^{12}$, about $10^8$ to about $10^{15}$, about $10^8$ to about $10^{17}$, about $10^9$ to about $10^{10}$, about $10^9$ to about $10^{12}$, about $10^9$ to about $10^{15}$, about $10^9$ to about $10^{17}$, about $10^{10}$ to about $10^{12}$, about $10^{10}$ to about $10^{15}$, about $10^{10}$ to about $10^{17}$, about $10^{12}$ to about $10^{15}$, about $10^{12}$ to about $10^{17}$, or about $10^{15}$ to about $10^{17}$ cells/gram of seed. In some embodiments, the solution comprises about $10^3$, about $10^4$, about $10^5$, about $10^6$, about $10^7$, about $10^8$, about $10^9$, about $10^{10}$, about $10^{12}$, about $10^{15}$, or about $10^{17}$ cells/gram of seed. In some embodiments, the solution comprises at least about $10^3$, about $10^4$, about $10^5$, about $10^6$, about $10^7$, about $10^8$, about $10^9$, about $10^{10}$, about $10^{12}$, or about $10^{15}$ cells/gram of seed. In some embodiments, the solution comprises at most about $10^4$, about $10^5$, about $10^6$, about $10^7$, about $10^8$, about $10^9$, about $10^{10}$, about $10^{12}$, about $10^{15}$, or about $10^{17}$ cells/gram of seed. In some embodiments, the solution comprises less than $10^{10}$ cells/gram of seed. In some embodiments, the solution comprises less than $10^9$ cells/gram of seed. In some embodiments, the solution comprises less than $10^8$ cells/gram of seed. In some embodiments, the solution comprises less than $10^{11}$ cells/gram of seed. In some embodiments, the solution comprises about $10^5$ to about $10^9$ cells/gram of seed.

In some embodiments, the seeds comprise a desired amount of microorganism per seed. In some embodiments, solution comprises from about $10^3$ to about $10^{17}$ colony forming units (CFU)/seed. In some embodiments, the solution comprises about $10^3$ to about $10^4$, about $10^3$ to about $10^5$, about $10^3$ to about $10^6$, about $10^3$ to about $10^7$, about $10^3$ to about $10^8$, about $10^3$ to about $10^9$, about $10^3$ to about $10^{10}$, about $10^3$ to about $10^{12}$, about $10^3$ to about $10^{15}$, about $10^3$ to about $10^{17}$, about $10^4$ to about $10^5$, about $10^4$ to about $10^6$, about $10^4$ to about $10^7$, about $10^4$ to about $10^8$, about $10^4$ to about $10^9$, about $10^4$ to about $10^{10}$, about $10^4$ to about $10^{12}$, about $10^4$ to about $10^{15}$, about $10^4$ to about $10^{17}$, about $10^5$ to about $10^6$, about $10^5$ to about $10^7$, about $10^5$ to about $10^8$, about $10^5$ to about $10^9$, about $10^5$ to about $10^{10}$, about $10^5$ to about $10^{12}$, about $10^5$ to about $10^{15}$, about $10^5$ to about $10^{17}$, about $10^6$ to about $10^7$, about $10^6$ to about $10^8$, about $10^6$ to about $10^9$, about $10^6$ to about $10^{10}$, about $10^6$ to about $10^{12}$, about $10^6$ to about $10^{15}$, about $10^6$ to about $10^{17}$, about $10^7$ to about $10^8$, about $10^7$ to about $10^9$, about $10^7$ to about $10^{10}$, about $10^7$ to about $10^{12}$, about $10^7$ to about $10^{15}$, about $10^7$ to about $10^{17}$, about $10^8$ to about $10^9$, about $10^8$ to about $10^{10}$, about $10^8$ to about $10^{12}$, about $10^8$ to about $10^{15}$, about $10^8$ to about $10^{17}$, about $10^9$ to about $10^{10}$, about $10^9$ to about $10^{12}$, about $10^9$ to about $10^{15}$, about $10^9$ to about $10^{17}$, $10^{10}$ to about $10^{12}$, about $10^{10}$ to about $10^{15}$, about $10^{10}$ to about $10^{17}$, about $10^{12}$ to about $10^{15}$, about $10^{12}$ to about $10^{17}$, or about $10^{15}$ to about $10^{17}$ CFU/seed. In some embodiments, the solution comprises about $10^3$, about $10^4$, about $10^5$, about $10^6$, about $10^7$, about $10^8$, about $10^9$, about $10^{10}$, about $10^{12}$, about $10^{15}$, or about $10^{17}$ CFU/seed. In some embodiments, the solution comprises at least about $10^3$, about $10^4$, about $10^5$, about $10^6$, about $10^7$, about $10^8$, about $10^9$, about $10^{10}$, about $10^{12}$, or about $10^{15}$ CFU/seed. In some embodiments, the solution comprises at most about $10^4$, about $10^5$, about $10^6$, about $10^7$, about $10^8$, about $10^9$, about $10^{10}$, about $10^{12}$, about $10^{15}$, or about $10^{17}$ CFU/seed. In some embodiments, the solution comprises less than $10^{10}$ CFU/seed. In some embodiments, the solution comprises less than $10^9$ CFU/seed. In some embodiments, the solution comprises less than $10^8$ CFU/seed. In some embodiments, the solution comprises less than $10^{11}$ CFU/seed. In some embodiments, the solution comprises about $10^5$ to about $10^9$ CFU/seed.

In some embodiments, the seeds comprise a desired amount of microorganism per seed. In some embodiments, solution comprises from about $10^3$ to about $10^{17}$ cells/seed. In some embodiments, the solution comprises about $10^3$ to about $10^4$, about $10^3$ to about $10^5$, about $10^3$ to about $10^6$, about $10^3$ to about $10^7$, about $10^3$ to about $10^8$, about $10^3$ to about $10^9$, about $10^3$ to about $10^{10}$, about $10^3$ to about $10^{12}$, about $10^3$ to about $10^{15}$, about $10^3$ to about $10^{17}$, about $10^4$ to about $10^5$, about $10^4$ to about $10^6$, about $10^4$ to about $10^7$, about $10^4$ to about $10^8$, about $10^4$ to about $10^9$, about $10^4$ to about $10^{10}$, about $10^4$ to about $10^{12}$, about $10^4$ to about $10^{15}$, about $10^4$ to about $10^{17}$, about $10^5$ to about $10^6$, about $10^5$ to about $10^7$, about $10^5$ to about $10^8$, about $10^5$ to about $10^9$, about $10^5$ to about $10^{10}$, about $10^5$ to about $10^{12}$, about $10^5$ to about $10^{15}$, about $10^5$ to about $10^{17}$, about $10^6$ to about $10^7$, about $10^6$ to about $10^8$, about $10^6$ to about $10^9$, about $10^6$ to about $10^{10}$, about $10^6$ to about $10^{12}$, about $10^6$ to about $10^{15}$, about $10^6$ to about $10^{17}$, about $10^7$ to about $10^8$, about $10^7$ to about $10^9$, about $10^7$ to about $10^{10}$, about $10^7$ to about $10^{12}$, about $10^7$ to about $10^{15}$, about $10^7$ to about $10^{17}$, about $10^8$ to about $10^9$, about $10^8$ to about $10^{10}$, about $10^8$ to about $10^{12}$, about $10^8$ to about $10^{15}$, about $10^8$ to about $10^{17}$, about $10^9$ to about $10^{10}$, about $10^9$ to about $10^{12}$, about $10^9$ to about $10^{15}$, about $10^9$ to about $10^{17}$, about $10^{10}$ to about $10^{12}$, about $10^{10}$ to about $10^{15}$, about $10^{10}$ to about $10^{17}$, about $10^{12}$ to about $10^{15}$, about $10^{12}$ to about $10^{17}$, or about $10^{15}$ to about $10^{17}$ cells/seed. In some embodiments, the solution comprises about $10^3$, about $10^4$, about $10^5$, about $10^6$, about $10^7$, about $10^8$, about $10^9$, about $10^{10}$, about $10^{12}$, about $10^{15}$, or about $10^{17}$ cells/seed. In some embodiments, the solution comprises at least about $10^3$, about $10^4$, about $10^5$, about $10^6$, about $10^7$, about $10^8$, about $10^9$, about $10^{10}$, about $10^{12}$, or about $10^{15}$ cells/seed. In some embodiments, the solution comprises at most about $10^4$, about $10^5$, about $10^6$, about $10^7$, about $10^8$, about $10^9$, about $10^{10}$, about $10^{12}$, about $10^{15}$, or about $10^{17}$ cells/seed. In some embodiments, the solution comprises less than $10^{10}$ cells/seed. In some embodiments, the solution comprises less than $10^9$ cells/seed. In some embodiments, the solution comprises less than $10^8$ cells/seed. In some embodiments, the solution comprises less than $10^{11}$ cells/seed. In some embodiments, the solution comprises about $10^5$ to about $10^9$ cells/seed In some embodiments, the microorganism is a bacteria. In some embodiments, the bacteria is an endospore forming bacteria. In some embodiments, the method comprises inducing endosporulation of the endospore forming bacteria. In some embodiments, the bacteria incorporated into the seed is an endospore. In some embodiments, the solution comprises one or more ingredients to induce endosporulation. In some embodiments, the solution comprises potassium, ferrous sulfate, calcium, magnesium, managanese, or a combination thereof.

In some embodiments, the method comprises sterilizing the seeds. In some embodiments, the method comprises sterilizing the surface of the seeds. Any method of producing a seed with a sterilized surface may be employed. In some embodiments, the seed is sterilized with a bleach solution. In some embodiments, the seeds are sterilized prior to immersing the seeds in the solution containing the one or more microorganisms. In some embodiments, the seed is a sterilized seed. In some embodiments, the seed has a sterilized surface. As used herein, "sterilizing," "sterilized" and related terms (e.g. "disinfecting" and the like) indicates that there are substantially no microorganisms alive on the sterilized item. In some embodiments, the seed is sterilized prior to incubating the seed in the solution comprising the microorganism. In some embodiments, the seed is sterilized after incubating the seed in the solution comprising the microorganism. In some embodiments, a fungicide is added to the surface of the seed.

In some embodiments, the sterilized or disinfected seeds comprise substantially no living microorganisms on the seed (e.g. the surface of the seed). In some embodiments, the sterile or sterilized seed comprises less than 1 CFU, less than 5 CFU, less than 10 CFU, less than 20 CFU, less than 30 CFU, less than 40 CFU, or less than 50 CFU of microorganisms on the seed.

In some embodiments, the plant seeds are incubated with the solution containing the microorganism for a time sufficient to incorporate the microorganism into the seed. In some embodiments, the plant seeds are incubated with the solution containing endospore forming bacteria or endospores thereof for about 1 minute to about 960 minutes. In some embodiments, the plant seeds are incubated with the solution containing endospore forming bacteria or endospores thereof for about 1 minute to about 5 minutes, about 1 minute to about 10 minutes, about 1 minute to about 20 minutes, about 1 minute to about 60 minutes, about 1 minute to about 240 minutes, about 1 minute to about 960 minutes, about 5 minutes to about 10 minutes, about 5 minutes to about 20 minutes, about 5 minutes to about 60 minutes, about 5 minutes to about 240 minutes, about 5 minutes to about 960 minutes, about 10 minutes to about 20 minutes, about 10 minutes to about 60 minutes, about 10 minutes to about 240 minutes, about 10 minutes to about 960 minutes, about 20 minutes to about 60 minutes, about 20 minutes to about 240 minutes, about 20 minutes to about 960 minutes, about 60 minutes to about 240 minutes, about 60 minutes to about 960 minutes, or about 240 minutes to about 960 minutes. In some embodiments, the plant seeds are incubated with the solution containing endospore forming bacteria or endospores thereof for about 1 minute, about 5 minutes, about 10 minutes, about 20 minutes, about 60 minutes, about 240 minutes, or about 960 minutes. In some embodiments, the plant seeds are incubated with the solution containing endospore forming bacteria or endospores thereof for at least about 1 minute, about 5 minutes, about 10 minutes, about 20 minutes, about 60 minutes, or about 240 minutes. In some embodiments, the plant seeds are incubated with the solution containing endospore forming bacteria or endospores thereof for at most about 5 minutes, about 10 minutes, about 20 minutes, about 60 minutes, about 240 minutes, or about 960 minutes. In some embodiments, the plant seeds are incubated with the solution containing endospore forming bacteria or endospores thereof for about 1 minute. In some embodiments, the plant seeds are incubated with the solution containing endospore forming bacteria or endospores thereof for about 5 minutes. In some embodiments, the plant seeds are incubated with the solution containing endospore forming bacteria or endospores thereof for about 10 minutes. In some embodiments, the plant seeds are incubated with the solution containing endospore forming bacteria or endospores thereof for about 20 minutes. In some embodiments, the plant seeds are incubated with the solution containing endospore forming bacteria or endospores thereof for about 60 minutes. In some embodiments, the plant seeds are incubated with the solution containing endospore forming bacteria or endospores thereof for about 240 minutes. In some embodiments, the plant seeds are incubated with the solution containing endospore forming bacteria or endospores thereof for about 960 minutes.

In some embodiments, the plant seeds are incubated with the solution containing the microorganism or exudate thereof for about 1 minute to about 960 minutes. In some embodiments, the plant seeds are incubated with the solution containing the microorganism or exudate thereof for about 1 minute to about 5 minutes, about 1 minute to about 10 minutes, about 1 minute to about 20 minutes, about 1 minute to about 60 minutes, about 1 minute to about 240 minutes, about 1 minute to about 960 minutes, about 5 minutes to about 10 minutes, about 5 minutes to about 20 minutes, about 5 minutes to about 60 minutes, about 5 minutes to about 240 minutes, about 5 minutes to about 960 minutes, about 10 minutes to about 20 minutes, about 10 minutes to about 60 minutes, about 10 minutes to about 240 minutes, about 10 minutes to about 960 minutes, about 20 minutes to about 60 minutes, about 20 minutes to about 240 minutes, about 20 minutes to about 960 minutes, about 60 minutes to about 240 minutes, about 60 minutes to about 960 minutes, or about 240 minutes to about 960 minutes. In some embodiments, the plant seeds are incubated with the solution containing the microorganism or exudate thereof for about 1 minute, about 5 minutes, about 10 minutes, about 20 minutes, about 60 minutes, about 240 minutes, or about 960 minutes. In some embodiments, the plant seeds are incubated with the solution containing the microorganism or exudate thereof for at least about 1 minute, about 5 minutes, about 10 minutes, about 20 minutes, about 60 minutes, or about 240 minutes. In some embodiments, the plant seeds are incubated with the solution containing the microorganism or exudate thereof for at most about 5 minutes, about 10 minutes, about 20 minutes, about 60 minutes, about 240 minutes, or about 960 minutes. In some embodiments, the plant seeds are incubated with the solution containing the microorganism or exudate thereof for about 1 minute. In some embodiments, the plant seeds are incubated with the solution containing the microorganism or exudate thereof for about 5 minutes. In some embodiments, the plant seeds are incubated with the solution containing the microorganism or exudate thereof for about 10 minutes. In some embodiments, the plant seeds are incubated with the solution containing the microorganism or exudate thereof for about 20 minutes. In some embodiments, the plant seeds are incubated with the solution containing the microorganism or exudate thereof for about 60 minutes. In some embodiments, the plant seeds are incubated with the solution containing the microorganism or exudate thereof for about 240 minutes. In some embodiments, the plant seeds are incubated with the solution containing the microorganism or exudate thereof for about 960 minutes.

In some embodiments, the seeds are incubated with the solution at a desired temperature. In some embodiments, the seeds are incubated with the solution at a temperature of about 2 to about 40° C. In some embodiments, the seeds are incubated with the solution at a temperature of about 2 to about 4, about 2 to about 8, about 2 to about 12, about 2 to about 16, about 2 to about 25, about 2 to about 30, about 2 to about 35, about 2 to about 40, about 4 to about 8, about 4 to about 12, about 4 to about 16, about 4 to about 25, about 4 to about 30, about 4 to about 35, about 4 to about 40, about 8 to about 12, about 8 to about 16, about 8 to about 25, about 8 to about 30, about 8 to about 35, about 8 to about 40, about 12 to about 16, about 12 to about 25, about 12 to about 30, about 12 to about 35, about 12 to about 40, about 16 to about 25, about 16 to about 30, about 16 to about 35, about 16 to about 40, about 25 to about 30, about 25 to about 35, about 25 to about 40, about 30 to about 35, about 30 to about 40, or about 35 to about 40° C. In some embodiments, the seeds are incubated with the solution at a temperature of about 2, about 4, about 8, about 12, about 16, about 25, about 30, about 35, or about 40° C. In some embodiments, the seeds are incubated with the solution at a temperature of at least about 2, about 4, about 8, about 12, about 16, about 25, about 30, or about 35° C. In some embodiments, the seeds are incubated with the solution at a temperature of at most about 4, about 8, about 12, about 16, about 25, about 30, about 35, or about 40° C.

In some embodiments, the method comprises drying seeds. In some embodiments, the seeds are dried to about 10% of total seed moisture. In some embodiments, the seeds are dried to about 5% to about 25% of total seed moisture. In some embodiments, the seeds are dried to about 5% to about 8%, about 5% to about 10%, about 5% to about 12%, about 5% to about 15%, about 5% to about 20%, about 5% to about 25%, about 8% to about 10%, about 8% to about 12%, about 8% to about 15%, about 8% to about 20%, about 8% to about 25%, about 10% to about 12%, about 10% to about 15%, about 10% to about 20%, about 10% to about 25%, about 12% to about 15%, about 12% to about 20%, about 12% to about 25%, about 15% to about 20%, about 15% to about 25%, or about 20% to about 25% of total seed moisture. In some embodiments, the seeds are dried to about 5%, about 8%, about 10%, about 12%, about 15%, about 20%, or about 25% of total seed moisture. In some embodiments, the seeds are dried to at least about 5%, about 8%, about 10%, about 12%, about 15%, or about 20% of total seed moisture. In some embodiments, the seeds are dried to at most about 8%, about 10%, about 12%, about 15%, about 20%, or about 25% of total seed moisture. In some embodiments, the seeds are dried to prevent germination of the seeds. In some embodiments, the seeds are dried to prevent germination prior to planting the seeds.

Formulations for Incorporating Microorganisms

In one aspect, provided herein, is a formulation for incorporating microorganisms, endospores, or exudates thereof into a seed. In some embodiments, the formulation comprises one or more microorganisms or endospores thereof and a salt. The one or more microorganisms can be any of the microorganisms provided herein or endospores thereof. In some embodiments, the one or more microorganisms comprises one or more endospore forming bacteria or endospores thereof. In some embodiments, the formulation comprises an exudate of a microorganism. The exudate can be from any of the microorganisms provided herein.

In some embodiments, the formulation is a solution. In some embodiments, the formulation is an aqueous solution.

In some embodiments, the formulation comprises a salt. The salt may be present in the formulation at any suitable concentration. In some embodiments, the formulation comprises about 0.85% salt (w/v). In some embodiments, the formulation comprises about 0.1% to about 1.25% salt (w/v). In some embodiments, the formulation comprises about 0.1% to about 2.0% salt (w/v). In some embodiments, the formulation comprises about 0.1% to about 0.25%, about 0.1% to about 0.5%, about 0.1% to about 0.6%, about 0.1% to about 0.7%, about 0.1% to about 0.75%, about 0.1% to about 0.8%, about 0.1% to about 0.85%, about 0.1% to about 0.9%, about 0.1% to about 0.95%, about 0.1% to about 1%, about 0.1% to about 1.25%, about 0.25% to about 0.5%, about 0.25% to about 0.6%, about 0.25% to about 0.7%, about 0.25% to about 0.75%, about 0.25% to about 0.8%, about 0.25% to about 0.85%, about 0.25% to about 0.9%, about 0.25% to about 0.95%, about 0.25% to about 1%, about 0.25% to about 1.25%, about 0.5% to about 0.6%, about 0.5% to about 0.7%, about 0.5% to about 0.75%, about 0.5% to about 0.8%, about 0.5% to about 0.85%, about 0.5% to about 0.9%, about 0.5% to about 0.95%, about 0.5% to about 1%, about 0.5% to about 1.25%, about 0.6% to about 0.7%, about 0.6% to about 0.75%, about 0.6% to about 0.8%, about 0.6% to about 0.85%, about 0.6% to about 0.9%, about 0.6% to about 0.95%, about 0.6% to about 1%, about 0.6% to about 1.25%, about 0.7% to about 0.75%, about 0.7% to about 0.8%, about 0.7% to about 0.85%, about 0.7% to about 0.9%, about 0.7% to about 0.95%, about 0.7% to about 1%, about 0.7% to about 1.25%, about 0.75% to about 0.8%, about 0.75% to about 0.85%, about 0.75% to about 0.9%, about 0.75% to about 0.95%, about 0.75% to about 1%, about 0.75% to about 1.25%, about 0.8% to about 0.85%, about 0.8% to about 0.9%, about 0.8% to about 0.95%, about 0.8% to about 1%, about 0.8% to about 1.25%, about 0.85% to about 0.9%, about 0.85% to about 0.95%, about 0.85% to about 1%, about 0.85% to about 1.25%, about 0.9% to about 0.95%, about 0.9% to about 1%, about 0.9% to about 1.25%, about 0.95% to about 1%, about 0.95% to about 1.25%, or about 1% to about 1.25% salt (w/v). In some embodiments, the formulation comprises about 0.1%, about 0.25%, about 0.5%, about 0.6%, about 0.7%, about 0.75%, about 0.8%, about 0.85%, about 0.9%, about 0.95%, about 1%, or about 1.25% salt (w/v). In some embodiments, the formulation comprises at least about 0.1%, about 0.25%, about 0.5%, about 0.6%, about 0.7%, about 0.75%, about 0.8%, about 0.85%, about 0.9%, about 0.95%, or about 1% salt (w/v). In some embodiments, the formulation comprises at most about 0.25%, about 0.5%, about 0.6%, about 0.7%, about 0.75%, about 0.8%, about 0.85%, about 0.9%, about 0.95%, about 1%, or about 1.25% salt (w/v). In some embodiments, the formulation comprises about 0.85% salt (w/v). In some embodiments, the formulation comprises from about 0.8% to about 0.9% salt (w/v). In some embodiments, the formulation comprises from about 0.75% to about 0.95% salt (w/v). In some embodiments, the formulation comprises from about 0.7% to about 1% salt (w/v). In some embodiments, the formulation comprises from about 0.5% to about 1.25% salt (w/v). In some embodiments, the formulation comprises from about 0.5% to about 2% salt (w/v). In some embodiments, the formulation comprises 0.1-0.2%, 0.2-0.3%, 0.3-0.4%, 0.4-0.5%, 0.5-0.6%, 0.6-0.7%, 0.7-0.8%, 0.8-0.9%, 0.9-1.0%, 1.0-1.1%, 1.1-1.2%, 1.2-1.3%, 1.3-1.4%, or 1.4-1.5% salt (w/v).

Any salt may be used. In some preferred embodiments, the salt is NaCl. In some embodiments, the salt is NaCl, LiCl, KCl, $MgCl_2$, $CaCl_2$, NaBr, LiBr, KBr, $MgBr_2$, $CaBr_2$, NaI, LiI, KI, $MgI_2$, or $CaI_2$. In some embodiments, the salt comprises sodium, lithium, or potassium ions. In some embodiments, the salt comprises alkali metal ions. In some embodiments, the salt comprises alkaline earth metal ions. In some embodiments, the salt comprises halide ions. In some embodiments, the salt is an alkali or alkaline earth halide salt. In some embodiments, the salt comprises chloride, bromide, or iodide ions. In some embodiments, the salt is a sulfate, phosphate, carbonate, or nitrate salt.

In some embodiments, the formulation comprises an additional additive. In some embodiments, the formulation comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (e.g. Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof. In some embodiments, the formulation comprises polyethylene glycol monolaurate (e.g. Tween 20), Poloxamer 188, Poloxamer 237, Poloxamer 338, Poloxamer 407, or a combination thereof. In some embodiments, the formulation comprises a Poloxamer. In some embodiments, the formulation comprises polyethylene glycol monolaurate (e.g. Tween 20). The additional additive may be present at any concentration. In some embodiments, the additional additive comprises up to about 0.01%, 0.05%, 0.1%, 0.125%, 0.15%, 0.2%, 0.5% or 1% (v/v) of the formulation. In some embodiments, the additional additive comprises about 0.01% to about 1% (v/v) of the formulation. In some embodiments, the additional additive comprises about 0.1% (v/v) of the formulation.

In some embodiments, the formulation comprises an additional metal ion. In some embodiments, the formulation comprises magnesium, calcium, managanese, or any combination thereof. In some embodiments, the formulation comprises magnesium. In some embodiments, the formulation comprises calcium. In some embodiments, the formulation comprises manganese. In some embodiments, the formulation comprises magnesium and calcium. In some embodiments, the formulation comprises magnesium and manganese. In some embodiments, the formulation comprises calcium and manganese. In some embodiments, the formulation comprises magnesium, calcium, and managanese.

In some embodiments, the formulation comprises one or more nutrients for the microorganisms. In some embodiments, the formulation comprises a bacterial growth media. In some embodiments, the formulation comprises lysogeny broth (LB), nutrient broth, or a combination thereof. In some embodiments, the formulation comprises lysogeny broth. In some embodiments, the formulation comprises nutrient broth.

In some embodiments, the formulation comprises additional ingredient for promoting endosporulation of the one or more microorganisms. In some embodiments, the formulation comprises the formulation comprises potassium, ferrous sulfate, calcium, magnesium, managanese, or a combination thereof. In some embodiments, the formulation comprises potassium. In some embodiments, the formulation comprises ferrous sulfate. In some embodiments, the formulation comprises calcium. In some embodiments, the formulation comprises magnesium. In some embodiments, the formulation comprises manganese.

In some embodiments, the formulation comprises a microorganism. In some embodiments, formulation comprises from about $10^3$ to about $10^{17}$ colony forming units (CFU)/mL of the microorganism. In some embodiments, the formulation comprises at least $1\times10^6$ CFU/mL of the microorganism. In some embodiments, the formulation comprises about $10^3$ to about $10^4$, about $10^3$ to about $10^5$, about $10^3$ to about $10^6$, about $10^3$ to about $10^7$, about $10^3$ to about $10^8$, about $10^3$ to about $10^9$, about $10^3$ to about $10^{10}$, about $10^3$ to about $10^{12}$, about $10^3$ to about $10^{15}$, about $10^3$ to about $10^{17}$, about $10^4$ to about $10^5$, about $10^4$ to about $10^6$, about $10^4$ to about $10^7$, about $10^4$ to about $10^8$, about $10^4$ to about $10^9$, about $10^4$ to about $10^{10}$, about $10^4$ to about $10^{12}$, about $10^4$ to about $10^{15}$, about $10^4$ to about $10^{17}$, about $10^5$ to about $10^6$, about $10^5$ to about $10^7$, about $10^5$ to about $10^8$, about $10^5$ to about $10^9$, about $10^5$ to about $10^{10}$, about $10^5$ to about $10^{12}$, about $10^5$ to about $10^{15}$, about $10^5$ to about $10^{17}$, about $10^6$ to about $10^7$, about $10^6$ to about $10^8$, about $10^6$ to about $10^9$, about $10^6$ to about $10^{10}$, about $10^6$ to about $10^{12}$, about $10^6$ to about $10^{15}$, about $10^6$ to about $10^{17}$, about $10^7$ to about $10^8$, about $10^7$ to about $10^9$, about $10^7$ to about $10^{10}$, about $10^7$ to about $10^{12}$, about $10^7$ to about $10^{15}$, about $10^7$ to about $10^{17}$, about $10^8$ to about $10^9$, about $10^8$ to about $10^{10}$, about $10^8$ to about $10^{12}$, about $10^8$ to about $10^{15}$, about $10^8$ to about $10^{17}$, about $10^9$ to about $10^{10}$, about $10^9$ to about $10^{12}$, about $10^9$ to about $10^{15}$, about $10^9$ to about $10^{17}$, about $10^{10}$ to about $10^{12}$, about $10^{10}$ to about $10^{15}$, about $10^{10}$ to about $10^{17}$, about $10^{12}$ to about $10^{15}$, about $10^{12}$ to about $10^{17}$, or about $10^{15}$ to about $10^{17}$ CFU/mL of the microorganism. In some embodiments, the formulation comprises about $10^3$, about $10^4$, about $10^5$, about $10^6$, about $10^7$, about $10^8$, about $10^9$, about $10^{10}$, about $10^{12}$, about $10^{15}$, or about $10^{17}$ CFU/mL of the microorganism. In some embodiments, the formulation comprises at least about $10^3$, about $10^4$, about $10^5$, about $10^6$, about $10^7$, about $10^8$, about $10^9$, about $10^{10}$, about $10^{12}$, or about $10^{15}$ CFU/mL of the microorganism. In some embodiments, the formulation comprises at most about $10^4$, about $10^5$, about $10^6$, about $10^7$, about $10^8$, about $10^9$, about $10^{10}$, about $10^{12}$, about $10^{15}$, or about $10^{17}$ CFU/mL of the microorganism. In some embodiments, the formulation comprises at least about $10^6$ to $10^7$ CFU/mL of the microorganism. In some embodiments, the formulation comprises $1\times10^3$ to $1\times10^4$ CFU/mL; $1\times10^4$ to $1\times10^5$ CFU/mL; $1\times10^5$ to $1\times10^6$ CFU/mL; $1\times10^6$ to $1\times10^7$ CFU/mL; $1\times10^7$ to $1\times10^8$ CFU/mL; $1\times10^8$ to $1\times10^9$ CFU/mL; $1\times10^9$ to $1\times10^{10}$ CFU/mL; $1\times10^{10}$ to $1\times10^{11}$ CFU/mL; $1\times10^{11}$ to $1\times10^{12}$ CFU/mL; $1\times10^{12}$ to $1\times10^{13}$ CFU/mL; $1\times10^{13}$ to $1\times10^{14}$ CFU/mL; $1\times10^{14}$ to $1\times10^{15}$ CFU/mL; $1\times10^{15}$ to $1\times10^{16}$ CFU/mL; or $1\times10^{16}$ to $1\times10^{17}$ CFU/mL of the microorganism. The microorganism can be any of the microorganisms provided herein or an endospore of any of the microorganisms provided herein.

In some embodiments, the formulation is maintained at a desired temperature. In some embodiments, the formulation is maintained at a temperature of about 2 to about 40° C. In some embodiments, the formulation is maintained at a temperature of about 2 to about 4, about 2 to about 8, about 2 to about 12, about 2 to about 16, about 2 to about 25, about 2 to about 30, about 2 to about 35, about 2 to about 40, about 4 to about 8, about 4 to about 12, about 4 to about 16, about 4 to about 25, about 4 to about 30, about 4 to about 35, about 4 to about 40, about 8 to about 12, about 8 to about 16, about 8 to about 25, about 8 to about 30, about 8 to about 35, about 8 to about 40, about 12 to about 16, about 12 to about 25, about 12 to about 30, about 12 to about 35, about 12 to about 40, about 16 to about 25, about 16 to about 30, about 16 to about 35, about 16 to about 40, about 25 to about 30, about 25 to about 35, about 25 to about 40, about 30 to about 35, about 30 to about 40, or about 35 to about 40° C. In some embodiments, the formulation is maintained at a temperature of about 2, about 4, about 8, about 12, about 16, about 25, about 30, about 35, or about 40° C. In some embodiments, the formulation is maintained at a temperature are of at least about 2, about 4, about 8, about 12, about 16, about 25, about 30, or about 35° C. In some embodiments, the formulation is maintained at a temperature of at most about 4, about 8, about 12, about 16, about 25, about 30, about 35, or about 40° C.

Microorganisms and Exudates

The microorganisms or exudates thereof provided herein are capable of imparting a plant growth promoting effect when incorporated into a plant seed. In some embodiments, the microorganism is a bacteria. In some embodiments, the microorganism is an endospore forming bacteria. In some embodiments, the microorganism is an endospore of a bacteria. Whenever a microorganism (e.g. a bacteria) referenced herein is capable of forming an endospore, it is intended that any endospore of the microorganism is also encompassed. For example, if a plant seed treatment formulation comprises a *Bacillus* sp., the formulation may comprise endospores of the *Bacillus* sp.

In some embodiments, the microorganism is a microbe from the phyla of Firmicutes, Proteobacteria, and Actinobacteria. In some embodiments, the microorganism is a microbe from the phylum Firmicutes. In some embodiments, the microorganism is a microbe from the phylum Proteobacteria. In some embodiments, the microorganism is a microbe from the phylum Actinobacteria. In some embodiments, the microorganism is an endospore of any of the microorganisms.

In some embodiments, the microorganism is a microbe selected from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terri bacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp. and *Vulcanobacillus* sp. In some embodiments, the microorganism is a microbe selected from *Acetobacter* sp., *Actinomyces* sp., *Bacillus* sp., *Chryseobacterium* sp., *Coxiella* sp., *Ensifer* sp., *Glutamicibacter* sp., *Microbacterium* sp., or *Serratia* sp. In some embodiments, the microorganism is an *Acetobacter* sp. In some embodiments, the microorganism is an *Actinomyces* sp. In some embodiments, the microorganism is a *Bacillus* sp. In some embodiments, the microorganism is a *Chryseobacterium* sp. In some embodiments, the microorganism is a *Coxiella* sp. In some embodiments, the microorganism is an *Ensifer* sp. In some embodiments, the microorganism is a *Glutamicibacter* sp. In some embodiments, the microorganism is a *Microbacterium* sp. In some embodiments, the microorganism is a *Pantoea* sp. In some embodiments, the microorganism is a *Serratia* sp. In some embodiments, the microorganism is an endospore of any of the microorganisms.

In some embodiments, the microorganism comprises an *Acetobacter cerevisiae, Bacillus cucumis, Bacillus endophyticus, Bacillus megaterium, Bacillus nakamurai, Bacillus subtilis, Chryseobacterium lactis, Ensifer adhaerens, Glutamicibacter arilaitensis, Glutamicibacter halophytocola, Microbacterium chocolatum, Microbacterium yannicii, Pantoea allii, Serratia marcescens,* or *Serratia ureilytica.* In some embodiments, the microorganism comprises an *Acetobacter cerevisiae, Bacillus cucumis, Bacillus endophyticus, Bacillus megaterium, Bacillus nakamurai, Bacillus subtilis, Chryseobacterium lactis, Ensifer adhaerens, Glutamicibacter halophytocola, Microbacterium chocolatum, Pantoea allii,* or *Serratia marcescens.* In some embodiments, the microorganism comprises *Acetobacter cerevisiae.* In some embodiments, the microorganism comprises *Bacillus cucumis.* In some embodiments, the microorganism comprises *Bacillus endophyticus.* In some embodiments, the microorganism comprises *Bacillus megaterium.* In some embodiments, the microorganism comprises *Bacillus subtilis.* In some embodiments, the microorganism comprises *Chryseobacterium lactis.* In some embodiments, the microorganism comprises *Ensifer adhaerens.* In some embodiments, the microorganism comprises *Glutamicibacter halophytocola.* In some embodiments, the microorganism comprises *Microbacterium chocolatum.* In some embodiments, the microorganism comprises *Pantoea* In some embodiments, the microorganism comprises *Serratia marcescens.* In some embodiments, the microorganism is an endospore of any of the microorganisms.

In some embodiments, the microorganism is an endospore forming bacteria. In some embodiments, the endospore forming bacteria is from the genus *Bacillus.* In some embodiments, the endospore forming bacteria is a *Bacillus* sp. In some embodiments, the endospore forming bacteria comprises *Bacillus cucumis, Bacillus endophyticus, Bacillus megaterium, Bacillus nakamurai,* or *Bacillus subtilis.* In some embodiments, the endospore forming bacteria comprises *Bacillus cucumis, Bacillus endophyticus, Bacillus megaterium* or *Bacillus subtilis.* In some embodiments, the endospore forming bacteria comprises *Bacillus cucumis.* In some embodiments, the endospore forming bacteria comprises *Bacillus megaterium.* In some embodiments, the endospore forming bacteria comprises *Bacillus nakamurai.* In some embodiments, the endospore forming bacteria comprises *Bacillus subtilis.* In some embodiments, the microorganism is an endospore of any of the microorganisms.

In some embodiments, the microorganism is an endospore. In some embodiments, the endospore is from the genus *Bacillus.* In some embodiments, the endospore is a *Bacillus* sp. In some embodiments, the endospore comprises *Bacillus cucumis, Bacillus endophyticus, Bacillus megaterium, Bacillus nakamurai,* or *Bacillus subtilis.* In some embodiments, the endospore comprises *Bacillus cucumis, Bacillus endophyticus, Bacillus megaterium* or *Bacillus subtilis.* In some embodiments, the endospore comprises *Bacillus cucumis.* In some embodiments, the endospore comprises *Bacillus megaterium.* In some embodiments, the endospore comprises *Bacillus nakamurai.* In some embodiments, the endospore comprises *Bacillus subtilis.*

In some embodiments, a consortium of microorganisms is incorporated into the seed. In some embodiments, the consortium comprises two or more bacterium selected from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terri bacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp. and *Vulcanobacillus* sp. In some embodiments, the consortium comprises two or more bacterium selected from selected from *Acetobacter* sp., *Actinomyces* sp., *Bacillus* sp., *Chryseobacterium* sp., *Coxiella* sp., *Ensifer* sp., *Glutamicibacter* sp., *Microbacterium* sp., or *Serratia* sp. In some embodiments, the consortium comprises two, three, four, five, six, seven, eight, nine, ten, or more bacterium. In some embodiments, the consortium comprises two bacterium. In some embodiments, the consortium comprises three bacterium. In some embodiments, the consortium comprises four bacterium. In some embodiments, the consortium comprises five bacterium. In some embodiments, the consortium comprises six bacterium. In some embodiments, the consortium comprises endospores of any of the microorganisms.

In some embodiments, the consortium comprises a bacteria from the phylum *Bacillus* and one or more bacteria. In some embodiments, the consortium comprises a bacteria from the phylum *Bacillus* and one or more bacteria selected from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp.,

*Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp. and *Vulcanobacillus* sp. In some embodiments, the consortium comprises two or more bacterium selected from selected from *Acetobacter* sp., *Actinomyces* sp., *Bacillus* sp., *Chryseobacterium* sp., *Coxiella* sp., *Ensifer* sp., *Glutamicibacter* sp., *Microbacterium* sp., and *Serratia* sp. In some embodiments, the consortium comprises endospores of any of the microorganisms.

In some embodiments, the consortium comprises a mixture of two or more bacteria selected from *Bacillus endophyticus*, *Bacillus megaterium*, *Bacillus nakamurai*, *Bacillus subtilis*, *Chryseobacterium lactis*, *Ensifer adhaerens*, *Glutamicibacter arilaitensis*, *Glutamicibacter halophytocola*, *Microbacterium chocolatum*, *Microbacterium yannicii*, *Pantoea allii*, *Serratia marcescens*, and *Serratia ureilytica*. In some embodiments, the consortium comprises a mixture of two or more bacteria selected from *Acetobacter cerevisiae*, *Bacillus cucumis*, *Bacillus endophyticus*, *Bacillus megaterium*, *Bacillus nakamurai*, *Bacillus subtilis*, *Chryseobacterium lactis*, *Ensifer adhaerens*, *Glutamicibacter halophytocola*, *Microbacterium chocolatum*, *Pantoea allii*, and *Serratia marcescens*. In some embodiments, the consortium comprises a mixture of two, three, four, five, six, seven, eight, nine, or ten bacteria. In some embodiments, the consortium comprises two bacterium. In some embodiments, the consortium comprises three bacterium. In some embodiments, the consortium comprises four bacterium. In some embodiments, the consortium comprises five bacterium. In some embodiments, the consortium comprises six bacterium. In some embodiments, the consortium comprises endospores of any of the microorganisms.

In some embodiments, the consortium comprises two or more bacteria selected from *Acetobacter cereviseae*, *Chryseobacterium lactis*, *Bacillus cucumis*, *Bacillus endophyticus*, *Bacillus megaterium*, *Bacillus subtilis*, and *Ensifer adhaerens*. In some embodiments, the consortium comprises two bacterium. In some embodiments, the consortium comprises three bacterium. In some embodiments, the consortium comprises four bacterium. In some embodiments, the consortium comprises five bacterium. In some embodiments, the consortium comprises six bacterium. In some embodiments, the consortium comprises seven bacterium. In some embodiments, the consortium comprises endospores of any of the microorganisms.

In some embodiments, the consortium comprises two or more bacteria selected from *Acetobacter cereviseae*, *Chryseobacterium lactis*, *Bacillus endophyticus*, and *Bacillus megaterium*. In some embodiments, the consortium comprises two bacteria selected from *Acetobacter cereviseae*, *Chryseobacterium lactis*, *Bacillus endophyticus*, and *Bacillus megaterium*. In some embodiments, the consortium comprises two bacteria selected from *Acetobacter cereviseae*, *Chryseobacterium lactis*, *Bacillus endophyticus*, and *Bacillus megaterium*. In some embodiments, the consortium comprises three bacteria selected from *Acetobacter cereviseae*, *Chryseobacterium lactis*, *Bacillus endophyticus*, and *Bacillus megaterium*. In some embodiments, the consortium comprises a mixture of *Chryseobacterium lactis*, *Bacillus endophyticus*, and *Bacillus megaterium*. In some embodiments, the consortium comprises a mixture of *Chryseobacterium lactis*, *Bacillus endophyticus*, and *Bacillus megaterium*. In some embodiments, the consortium comprises endospores of any of the microorganisms.

In some embodiments, the consortium comprises two or more bacteria selected from *Bacillus subtilis*, *Bacillus cucumis*, and *Ensifer adhaerens*. In some embodiments, the consortium comprises *Ensifer adhaerens* and *Bacillus subtilis* or *Bacillus cucumis*. In some embodiments, the consortium comprises *Ensifer adhaerens* and *Bacillus subtilis*. In some embodiments, the consortium comprises *Ensifer adhaerens* and *Bacillus cucumis*. In some embodiments, the consortium comprises endospores of any of the microorganisms.

In some embodiments, an exudate from any of the microorganisms provided herein is incorporated into the cell. In some embodiments, the exudate is from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terri bacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp. or *Vulcanobacillus* sp. In some embodiments, the exudate is from *Acetobacter* sp., *Actinomyces* sp., *Bacillus* sp., *Chryseobacterium* sp., *Coxiella* sp., *Ensifer* sp., *Glutamicibacter* sp., *Microbacterium* sp., and *Serratia* sp. In some embodiments, the exudate is from *Acetobacter cerevisiae*, *Bacillus cucumis*, *Bacillus endophyticus*, *Bacillus megaterium*, *Bacillus nakamurai*, *Bacillus subtilis*, *Chryseobacterium lactis*, *Ensifer adhaerens*, *Glutamicibacter arilaitensis*, *Glutamicibacter halophytocola*, *Microbacterium chocolatum*, *Microbacterium yannicii*, *Pantoea allii*, *Serratia marcescens*, or *Serratia ureilytica*. In some embodiments, the exudate is from *Bacillus cucumis*, *Bacillus endophyticus*, *Bacillus megaterium*, *Bacillus nakamurai*, or *Bacillus sub-*

*tilis*. In some embodiments, the exudate is from endospores of any of the microorganisms.

In some embodiments, a microorganism provided herein comprises genes coding for one or more compounds that trigger plant development. In some embodiments, the compounds trigger Induced Systemic Tolerance (IST). In some embodiments, the compounds trigger Induces Systemic Resistance (ISR). In some embodiments, a microorganism comprises genes associated with nitrogen fixing, phosphate solubilization, or phytohormone synthesis, or any combination thereof. In some embodiments, a microorganism comprises genes associated with nitrogen fixing. In some embodiments, a microorganism comprises genes associated with phosphate solubilization. In some embodiments, a microorganism comprises genes associated with phytohormone synthesis.

In some embodiments, a microorganism is selected for one or more properties associated with the microorganism's ability to interact with the plant. In some embodiments, the microorganism is selected for compatibility. In some embodiments, the microorganism is selected to ensure no predatory or antagonistic effects will develop. In some embodiments, the microorganism is selected for stability during storage. In some embodiments, the microorganism is selected for rapid plant colonization and survival within associated tissues. In some embodiments, the microorganism is selected for stimulation of global, long-lasting physiological responses in a plant. In some embodiments, the microorganism is selected for accelerating the life cycle of the plant. In some embodiments, the microorganism is selected for optimal incorporation into the one or more seeds. In some embodiments, the microorganism remains present throughout the plant life cycle.

In some embodiments, a microorganism incorporated into a seed is stable after incorporation. In some embodiments, the microorganism is stable for greater than 30 days, for greater than six months, greater than one year, or greater than two years. In some embodiments, the microorganism is stable for greater than 30 days. In some embodiments, the microorganism is stable for greater than six months. In some embodiments, the microorganism is stable for greater than one year. In some embodiments, the microorganism is stable for greater than two years.

Whenever the term "at least," "greater than," or "greater than or equal to" precedes the first numerical value in a series of two or more numerical values, the term "at least," "greater than" or "greater than or equal to" applies to each of the numerical values in that series of numerical values. For example, greater than or equal to 1, 2, or 3 is equivalent to greater than or equal to 1, greater than or equal to 2, or greater than or equal to 3.

Whenever the term "no more than," "less than," or "less than or equal to" precedes the first numerical value in a series of two or more numerical values, the term "no more than," "less than," or "less than or equal to" applies to each of the numerical values in that series of numerical values. For example, less than or equal to 3, 2, or 1 is equivalent to less than or equal to 3, less than or equal to 2, or less than or equal to 1.

NUMBERED EMBODIMENTS

1. An engineered seed comprising: (i) a seed coat and an embryo having an interspace therebetween; and (ii) one or more microbes disposed in the interspace. 2. An engineered seed comprising: (i) a seed pericarp and a seed aleurone cell layer having an interspace therebetween; and (ii) one or more microbes disposed in the interspace. 3. An engineered seed comprising: (i) a seed pericarp and a seed aleurone cell layer; and (ii) one or more microbes disposed between the seed pericarp and seed aleurone cell layer. 4. The engineered seed of any one of the preceding embodiments, wherein the one or more microbes are selected to produce a plant growth promoting effect. 5. The engineered seed of any one of the preceding embodiments, wherein the seed is a monocot seed. 6. The engineered seed of any one of the preceding embodiments, wherein the seed is selected from a maize, rice, wheat, and sorghum seed. 7. The engineered seed of any one of the preceding embodiments, wherein the seed is a maize seed. 8. The engineered seed of any one of the preceding embodiments, wherein the seed is a *Zea* maize seed. 9. The engineered seed of any one of the preceding embodiments, wherein the seed is a dicot seed. 10. The engineered seed of any one of the preceding embodiments, wherein the seed is selected from a soybean, cotton, alfalfa, bean, quinoa, lentil, peanut, lettuce, tomato, and cabbage seed. 11. The engineered seed of any one of the preceding embodiments, wherein the seed is a lettuce seed or a tomato seed. 12. The engineered seed of any one of the preceding embodiments, wherein the seed is a *Lactuca sativa* seed or a *Solanum lycopersicum* seed. 13. The engineered seed of any one of the preceding embodiments, wherein the seed is a GMO seed. 14. The engineered seed of any one of the preceding embodiments, wherein the seed is a non-GMO seed. 15. The engineered seed of any one of the preceding embodiments, wherein the one or more microbes comprise a mixture of *Chryseobacterium lactis*, *Bacillus endophyticus*, and *Bacillus megaterium*. 16. The engineered seed of any one of the preceding embodiments, wherein the one or more microbes comprises a mixture of *Acetobacter cereviseae*, *Chryseobacterium lactis*, *Bacillus endophyticus*, and *Bacillus megaterium*. 17. The engineered seed of any one of the preceding embodiments, wherein the one or more microbes comprises a mixture of *Ensifer adhaerens* and *Bacillus nakamurai*, *Bacillus subtilis*, or *Bacillus cucumis*. 18. The engineered seed of any one of the preceding embodiments, wherein the one or more microbes comprises *Microbacterium yannicii* or *Microbacterium chocolatum*. 19. The engineered seed of any one of the preceding embodiments, wherein the one or more microbes comprises *Serratia ureilytica* or *Serratia marcescens*. 20. The engineered seed of any one of the preceding embodiments, wherein the one or more microbes comprise *Glutamicibacter arilaitensis* or *Glutamicibacter halophytocola*. 21. The engineered seed of any one of the preceding embodiments, wherein the one or more microbes comprise *Ensifer adhaerens*, *Pantoea allii*, *Bacillus subtilis*, or *Bacillus cucumis*. 22. The engineered seed of any one of the preceding embodiments, wherein the one or more microbes comprise endospore forming microbes. 23. The engineered seed of any one of the preceding embodiments, wherein the one or more microbes comprise a *Bacillus* sp. 24. The engineered seed of any one of the preceding embodiments, wherein the one or more microbes is selected from the phyla Firmicutes, Proteobacteria, and Actinobacteria. 25. The engineered seed of any one of the preceding embodiments, wherein the one or more microbes is selected from the phylum Firmicutes. 26. The engineered seed of any one of the preceding embodiments, wherein the one or more microbes is selected from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp.,

*Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp. and *Vulcanobacillus* sp. 27. The engineered seed of any one of the preceding embodiments, wherein the one or more microbes is selected from the phylum Proteobacteria. 28. The engineered seed of any one of the preceding embodiments, wherein the one or more microbes comprises *Actinomyces* sp. 29. The engineered seed of any one of the preceding embodiments, wherein the one or more microbes is selected from the phylum Actinobacteria. 30. The engineered seed of any one of the preceding embodiments, wherein the one or more microbes comprises *Coxiella* sp. 31. The engineered seed of any one of the preceding embodiments, wherein the one or more microbes form endospores after being disposed in the seed. 32. The engineered seed of any one of the preceding embodiments, wherein the one or more microbes comprise a *Bacillus* sp. 33. The engineered seed of any one of the preceding embodiments, wherein the one or more microbes comprise endospores. 34. The engineered seed of any one of the preceding embodiments, wherein the one or more microbes comprises a 16S nucleic acid sequence of any of SEQ ID NOs:1-10221. 35. The engineered seed of any one of the preceding embodiments, wherein the one or more microbes comprises a 16S nucleic acid sequence at least 99%, 98%, 97%, 96%, 95%, 94%, 93%, 92%, 91% or 90% identical to that of any of SEQ ID NOs:1-10221. 36. The engineered seed of any one of the preceding embodiments, wherein the one or more microbes comprises a 16S nucleic acid sequence at least 99% identical to that of any of SEQ ID NOs:1-10221. 37. The engineered seed of any one of the preceding embodiments, wherein the one or more microbes comprises a 16S nucleic acid sequence at least 98% identical to that of any of SEQ ID NOs:1-10221. 38. The engineered seed of any one of the preceding embodiments, wherein the one or more microbes comprises a 16S nucleic acid sequence at least 95% identical to that of any of SEQ ID NOs:1-10221. 39. The engineered seed of any one of the preceding embodiments, wherein the one or more microbes comprises a 16S nucleic acid sequence at least 90% identical to that of any of SEQ ID NOs:1-10221. 40. The engineered seed of any one of the preceding embodiments, wherein the one or more microbes comprise genes coding for one or more compounds that trigger Induced Systemic Tolerance (IST). 41. The engineered seed of any one of the preceding embodiments, wherein the one or more microbes comprise genes coding for one or more compounds that trigger Induced Systemic Resistance (ISR). 42. The engineered seed of any one of the preceding embodiments, wherein the one or more microbes comprise genes coding for one or more compounds that trigger plant development. 43. The engineered seed of any one of the preceding embodiments, wherein the one or more microbes comprise genes associated with nitrogen fixing. 44. The engineered seed of any one of the preceding embodiments, wherein the one or more microbes comprise genes associated with phosphate solubilization. 45. The engineered seed of any one of the preceding embodiments, wherein the one or more microbes comprise genes associated with phytohormone synthesis. 46. The engineered seed of any one of the preceding embodiments, further comprising a microbial exudate. 47. The engineered seed of any one of the preceding embodiments, wherein the microbial exudate contains one or more compounds that trigger Induced Systemic Tolerance (IST). 48. The engineered seed of any one of the preceding embodiments, wherein the microbial exudate contains one or more compounds that trigger Induced Systemic Resistance (ISR). 49. The engineered seed of any one of the preceding embodiments, wherein the microbial exudate contains one or more compounds that trigger plant development. 50. The engineered seed of any one of the preceding embodiments, wherein the microbial exudate is from a microbe comprising a 16S nucleic acid sequence of any of SEQ ID NOs:1-10221. 51. The engineered seed of any one of the preceding embodiments, wherein the microbial exudate is from a microbe comprising a 16S nucleic acid sequence at least 99%, 98%, 97%, 96%, 95%, 94%, 93%, 92%, 91% or 90% identical to that of any of SEQ ID NOs:1-10221. 52. The engineered seed of any one of the preceding embodiments, wherein the microbial exudate is from a microbe comprising a 16S nucleic acid sequence at least 99% identical to that of any of SEQ ID NOs:1-10221. 53. The engineered seed of any one of the preceding embodiments, wherein the microbial exudate is from a microbe comprising a 16S nucleic acid sequence at least 98% identical to that of any of SEQ ID NOs:1-10221. 54. The engineered seed of any one of the preceding embodiments, wherein the microbial exudate is from a microbe comprising a 16S nucleic acid sequence at least 95% identical to that of any of SEQ ID NOs:1-10221. 55. The engineered seed of any one of the preceding embodiments, wherein the microbial exudate is from a microbe comprising a 16S nucleic acid sequence at least 90% identical to that of any of SEQ ID NOs:1-10221.

56. A method of treating one or more plant seeds, the method comprising: immersing the one or more seeds into a formulation, the formulation comprising a salt and one or more microbes selected to produce a plant growth promoting effect; and incubating the one or more seeds in the formulation for a period of time sufficient to incorporate the one or more microbes into the seed.

57. A method of treating one or more plant seeds, the method comprising: (i) immersing the one or more seeds into a formulation, the formulation comprising a salt and one or more microbes selected to produce a plant growth promoting effect; and (ii) incubating the one or more seeds in the formulation to incorporate the bacteria between a seed pericarp and an aleurone cell layer. 58. The method of embodiment 57, wherein the one or more plant seeds remains in the dormant stage after treatment. 59. The method of embodiment 57 or 58, wherein the one or more plant seeds remains in the dormant stage after treatment. 60. The method of any one of embodiments 57-59, wherein the one or more microbes are incorporated inside a seed pericarp.

61. The method of any one of embodiments 57-60, wherein the one or more microbes are incorporated between a seed pericarp and aleurone cell layer. 62. The method of any one of embodiments 57-61, further comprising the step of removing the one or more seeds from the formulation. 63. The method of any one of embodiments 57-62, further comprising the step of sterilizing completely one or more seeds prior to immersing the one or more seeds in the formulation. 64. The method of any one of embodiments 57-63, further comprising the step of drying the one or more seeds. 65. The method of any one of embodiments 57-64, wherein the one or more seeds is/are dried to about 10% of total seed moisture. 66. The method of any one of embodiments 57-65, further comprising the step of drying the one or more seeds to prevent germination. 67. The method of any one of embodiments 57-66, further comprising the step of sterilizing the surface of the one or more seeds prior to immersing the one or more seeds in the formulation. 68. The method of any one of embodiments 57-67, further comprising the step of sterilizing the surface of the one or more seeds after immersing the one or more seeds in the formulation. 69. The method of any of embodiments 57-68, further comprising the step of adding a fungicide to the surface of the seed. 70. The method of any one of embodiments 57-69 wherein the one or more seeds comprise a monocot seed. 71. The method of any one of embodiments 57-70, wherein the seed is selected from a maize, a wheat, a rice, a barley, a rye, a sugar cane, a millet, an oat, and a sorghum seed. 72. The method of any one of embodiments 57-71, wherein the seed is a maize seed. 73. The method of any one of embodiments 57-72, wherein the seed is a *Zea mays* seed. 74. The method of any one of embodiments 57-73, wherein the seed is a dicot seed. 75. The method of any one of embodiments 57-74 wherein the seed is selected from a soybean, cotton, alfalfa, bean, quinoa, lentil, peanut, lettuce, tomato, and cabbage seed. 76. The method of any one of embodiments 57-75, wherein the seed is a lettuce seed or a tomato seed. 77. The method of any one of embodiments 57-76, wherein the seed is a *Lactuca sativa* seed or a *Solanum lycopersicum* seed. 78. The method of any one of embodiments 57-77, wherein the seed is a GMO seed. 79. The method of any one of embodiments 57-78, wherein the seed is a non-GMO seed. 80. The method of any one of embodiments 57-79, wherein the formulation is an aqueous formulation. 81. The method of any one of embodiments 57-80, wherein the formulation further comprises Poloxamer 188. 82. The method of any one of embodiments 57-81, wherein the formulation further comprises Poloxamer 188 at a concentration of 0.1%. 83. The method of any one of embodiments 57-82, wherein the formulation further comprises Tween 20. 84. The method of any one of embodiments 57-83 wherein the formulation further comprises one or more agent selected from the group of dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, and Poloxamer 407. 85. The method of any one of embodiments 57-84, wherein the formulation further comprises one or more ingredients that promote endosporulation of the one or more bacteria. 86. The method of any one of embodiments 57-85, wherein the formulation comprises potassium, ferrous sulfate, calcium, magnesium, managanese, or a combination thereof 87. The method of any one of embodiments 57-86, wherein the formulation further comprises manganese. 88. The method of any one of embodiments 57-87, wherein the formulation comprises calcium, magnesium, and manganese. 89. The method of any one of embodiments 57-88, wherein the formulation further comprises nutrients for the one or more microbes. 90. The method of any one of embodiments 57-89, wherein the formulation is at room temperature. 91. The method of any one of embodiments 57-90, wherein the formulation is at a temperature of about 4° C., 10° C., 15° C., 20° C., or 30° C. 92. The method of any one of embodiments 57-91, wherein the formulation is at a temperature of between about 4° C. and 20° C. or between about 30° C. and 40° C. 93. The method of any one of embodiments 57-92, wherein the formulation temperature is between about 20° C. and 24° C. 94. The method of any one of embodiments 57-93, wherein the formulation is at a temperature of about 40° C. 95. The method of any one of embodiments 57-94, wherein the salt comprises sodium chloride. 96. The method of any one of embodiments 57-95, wherein the salt is at a concentration of 0.1-0.2%, 0.2-0.3%, 0.3-0.4%, 0.4-0.5%, 0.5-0.6%, 0.6-0.7%, 0.7-0.8%, 0.8-0.9%, 0.9-1.0%, 1.0-1.1%, 1.1-1.2%, 1.2-1.3%, 1.3-1.4%, or 1.4-1.5%. 97. The method of any one of embodiments 57-96, wherein the salt is at a concentration of about 0.85%. 98. The method of any one of embodiments 57-97, wherein the salt is at a concentration of about 1.25% or less. 99. The method of any one of embodiments 57-98, wherein the salt is at a concentration of about 1.25%. 100. The method of any one of embodiments 57-99, wherein the one or more microbes is/are selected from *Acetobacter cereviseae*, *Chryseobacterium lactis*, *Bacillus endophyticus*, and *Bacillus megaterium*. 101. The method of any one of embodiments 57-100, wherein the one or more microbes comprises *Acetobacter cereviseae*, *Chryseobacterium lactis*, *Bacillus endophyticus*, and *Bacillus megaterium*. 102. The method of any one of embodiments 57-101, wherein the one or more microbes comprises *Chryseobacterium lactis*, *Bacillus endophyticus*, and *Bacillus megaterium*. 103. The method of any one of embodiments 57-102, wherein the one or more microbes comprises *Ensifer adhaerens* and *Bacillus nakamurai* or *Bacillus subtilis*. 104. The method of any one of embodiments 57-103, wherein the one or more microbes comprises *Microbacterium yannicii* or *Microbacterium chocolatum*. 105. The method of any one of embodiments 57-104, wherein the one or more microbes comprises *Serratia ureilytica* or *Serratia marcescens*. 106. The method of any one of embodiments 57-105, wherein the one or more microbes comprises *Glutamicibacter arilaitensis* or *Glutamicibacter halophytocola*. 107. The method of any one of embodiments 57-106, wherein the one or more microbes comprises *Ensifer adhaerens*, *Pantoea allii*, *Bacillus subtilis*, or *Bacillus cucumis*. 108. The method of any one of embodiments 57-107, wherein the one or more microbes comprise endospore forming microbes. 109. The method of any one of embodiments 57-108, wherein the one or more microbes comprises a *Bacillus* sp. 110. The method of any one of embodiments 57-109, wherein the one or more microbes is selected from the phyla Firmicutes, Proteobacteria, and Actinobacteria. 111. The method of any one of embodiments 57-110, wherein the one or more microbes is selected from the phylum Firmicutes. 112. The method of any one of embodiments 57-111, wherein the one or more microbes is selected from *Acetonema* sp., *Actinomyces* sp., *Alkalibacillus* sp., *Ammomphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasi-* bacillus sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp. and *Vulcanobacillus* sp. 113. The method of any of embodiments 57-112, wherein the one or more microbes is selected from the phylum Proteobacteria. 114. The method of any one of embodiments 57-113, wherein the one or more microbes comprises *Actinomyces* sp. 115. The method of any one of embodiments 57-114, wherein the one or more microbes is selected from the phylum Actinobacteria. 116. The method of any one of embodiments 57-115, wherein the one or more microbes comprises *Coxiella* sp. 117. The method of any one of embodiments 57-116, wherein the one or more microbes form endospores after being incorporated into the seed. 118. The method of any one of embodiments 57-117, wherein the one or more microbes comprise endospores. 119. The method of any one of embodiments 57-118, wherein the one or more microbes comprise *Bacillus* endospores. 120. The method of any one of embodiments 57-119, wherein the one or more microbes comprise a 16S nucleic acid sequence of any of SEQ ID NOs:1-10221. 121. The method of any one of embodiments 57-120, wherein the one or more microbes comprise a 16S nucleic acid sequence at least 99% identical to that of any of SEQ ID NOs:1-10221. 122. The method of any one of embodiments 57-121, wherein the one or more microbes comprise a 16S nucleic acid sequence at least 98% identical to that of any of SEQ ID NOs:1-10221. 123. The method of any one of embodiments 57-122, wherein the one or more microbes comprise a 16S nucleic acid sequence at least 95% identical to that of any of SEQ ID NOs:1-10221. 124. The method of any one of embodiments 57-123, wherein the one or more microbes comprise a 16S nucleic acid sequence at least 90% identical to that of any of SEQ ID NOs:1-10221. 125. The method of any one of embodiments 57-124, wherein the formulation further comprises a microbial exudate. 126. The method of any one of embodiments 57-125, wherein the microbial exudate contains one or more compounds that trigger Induced Systemic Tolerance (IST). 127. The method of any one of embodiments 57-126, wherein the microbial exudate contains one or more compounds that trigger Induced Systemic Resistance (ISR). 128. The method of any one of embodiments 57-127, wherein the microbial exudate contains one or more compounds that trigger plant development. 129. The method of any one of embodiments 57-128, wherein the microbial exudate is from a microbe comprising a 16S nucleic acid sequence of any of SEQ ID NOs:1-10221. 130. The method of any one of embodiments 57-129, wherein the microbial exudate is from a microbe comprising a 16S nucleic acid sequence at least 99% identical to that of any of SEQ ID NOs:1-10221. 131. The method of any one of embodiments 57-130, wherein the microbial exudate is from a microbe comprising a 16S nucleic acid sequence at least 98% identical to that of any of SEQ ID NOs:1-10221. 132. The method of any one of embodiments 57-131, wherein the microbial exudate is from a microbe comprising a 16S nucleic acid sequence at least 95% identical to that of any of SEQ ID NOs:1-10221. 133. The method of any one of embodiments 57-132, wherein the microbial exudate is from a microbe comprising a 16S nucleic acid sequence at least 90% identical to that of any of SEQ ID NOs:1-10221. 134. The method of any one of embodiments 57-133, wherein the concentration of the one or more microbes in the formulation is in the range of about $1\times10^6$ to $1\times10^{17}$ CFU/mL. 135. The method of any one of embodiments 57-134, wherein the concentration of the one or more microbes in the formulation is: $1\times10^3$ to $1\times10^4$ CFU/mL; $1\times10^4$ to $1\times10^5$ CFU/mL; $1\times10^5$ to $1\times10^6$ CFU/mL; $1\times10^6$ to $1\times10^7$ CFU/mL; $1\times10^7$ to $1\times10^8$ CFU/mL; $1\times10^8$ to $1\times10^9$ CFU/mL; $1\times10^9$ to $1\times10^{10}$ CFU/mL; $1\times10^{10}$ to $1\times10^{11}$ CFU/mL; $1\times10^{11}$ to $1\times10^{12}$ CFU/mL; $1\times10^{12}$ to $1\times10^{13}$ CFU/mL; $1\times10^{13}$ to $1\times10^{14}$ CFU/mL; $1\times10^{14}$ to $1\times10^{15}$ CFU/mL; $1\times10^{15}$ to $1\times10^{16}$ CFU/mL; or $1\times10^{16}$ to $1\times10^{17}$ CFU/mL. 136. The method of any one of embodiments 57-135, wherein the amount of the one or more microbes present in the formulation is less than $10^{10}$ CFU per gram of seed. 137. The method of any one of embodiments 57-136, wherein the amount of the one or more microbes present in the formulation is about $10^5$ to $10^9$ cells per gram of seed. 138. The method of any one of embodiments 57-137, wherein the one or more microbes are selected to produce a plant growth promoting effect. 139. The method of any one of embodiments 57-138, wherein the plant growth promoting effect of the one or more microbes is selected from one or more of the group comprising cell osmoregulation, ionic homeostasis, antioxidant defense, heat stress tolerance, and/or maintenance of photosynthetic capacity. 140. The method of any one of embodiments 57-139, wherein the one or more microbes are selected for compatibility. 141. The method of any one of embodiments 57-140, wherein the one or more microbes are selected to ensure no predatory or antagonistic effects will develop. 142. The method of any one of embodiments 57-141, wherein the one or more microbes is/are also selected for stability during storage. 143. The method of any one of embodiments 57-142, wherein the one or more microbes is/are also selected for rapid plant colonization and survival within associated tissues. 144. The method of any one of embodiments 57-143, wherein the one or more microbes is/are also selected for stimulation of global, long-lasting physiological responses in a plant. 145. The method of any one of embodiments 57-144, wherein the one or more microbes is/are also selected for accelerate the life cycle of the plant. 146. The method of any one of embodiments 57-145, wherein the one or more microbes is selected for optimal incorporation into the one or more seeds. 147. The method of any one of embodiments 57-146, wherein at least one of the microbes remains present throughout the plant life cycle. 148. The method of any one of embodiments 57-147, wherein the incubation time is less than one minute. 149. The method of any one of embodiments 57-148, wherein the incubation time is about one minute. 150. The method of any one of embodiments 57-149, wherein the incubation time is less than 10 minutes. 151. The method of any one of embodiments 57-150, wherein the incubation time is less than 5 minutes. 152. The method of any one of embodiments 57-151, wherein the incubation time is less than 20 minutes. 153. The method of any one of embodiments 57-152, wherein the incubation time is less than 4 hours or less than 16 hours. 154. The method of any one of embodiments 57-153, wherein the incubation time is less than several days. 155. The method of any one of embodiments 57-154, wherein the incubation time is less than 12 hours. 156. The method of any one of embodiments 57-155, wherein greater than $1 \times 10^6$ bacterial cells are incorporated into each of the one or more seeds. 157. The method of any one of embodiments 57-156, wherein between $1 \times 10^5$ and $1 \times 10^8$ bacterial cells are incorporated into each of the one or more seeds. 158. The method of any one of embodiments 57-157, wherein the one or more microbes are incorporated into the one or more seeds stably. 159. The method of any one of embodiments 57-158, wherein the incorporated one or more microbes is/are stable for greater than 30 days. 160. The method of any one of embodiments 57-159, wherein the incorporated one or more microbes is/are stable for greater than six months. 161. The method of any one of embodiments 57-160, wherein the incorporated one or more microbes is/are stable for at least one year. 162. The method of any one of embodiments 57-161, wherein the incorporated one or more microbes is/are stable for at least two years.

163. A plant seed treatment formulation, comprising salt and one or more microbes. 164. The formulation of embodiment 163, wherein the one or more microbes are selected to impart a plant growth promoting effect. 165. The formulation of embodiment 163 or 164, wherein the formulation is an aqueous formulation. 166. The formulation of any one of embodiments 163-165, wherein the formulation further comprises Poloxamer 188. 167. The formulation of any one of embodiments 163-166, further comprising Poloxamer 188 at a concentration of 0.1%. 168. The formulation of any one of embodiments 163-167, further comprising Tween 20. 169. The formulation of any one of embodiments 163-168, further comprising one or more agent from the group comprising dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, and Poloxamer 407. 170. The formulation of any one of embodiments 163-169, further comprising one or more ingredients that promote endosporulation of the one or more bacteria. 171. The formulation of any one of embodiments 163-170, further comprising potassium, ferrous sulfate, calcium, magnesium, managanese, or a combination thereof 172. The formulation of any one of embodiments 163-171, further comprising manganese. 173. The formulation of any one of embodiments 163-172, further comprising calcium, magnesium, and manganese. 174. The formulation of any one of embodiments 163-173, further comprising nutrients for the selected one or more microbes. 175. The medium of any one of embodiments 163-174, wherein the salt comprises sodium chloride. 176. The formulation of any one of embodiments 163-175, wherein the salt is at a concentration of 0.1-0.2%, 0.2-0.3%, 0.3-0.4%, 0.4-0.5%, 0.5-0.6%, 0.6-0.7%, 0.7-0.8%, 0.8-0.9%, 0.9-1.0%, 1.0-1.1%, 1.1-1.2%, 1.2-1.3%, 1.3-1.4%, or 1.4-1.5%. 177. The formulation of any one of embodiments 163-176, wherein the salt is at a concentration of about 0.85%. 178. The formulation of any one of embodiments 163-177, wherein the salt is at a concentration of about 1.25% or less. 179. The formulation of any one of embodiments 163-178, wherein the salt is at a concentration of about 1.25%. 180. The formulation of any one of embodiments 163-179, wherein the one or more microbes is/are selected from *Acetobacter cereviseae, Chryseobacterium lactis, Bacillus endophyticus*, and *Bacillus megaterium*. 181. The formulation of any one of embodiments 163-180, wherein the one or more microbes comprises *Acetobacter cereviseae, Chryseobacterium lactis, Bacillus endophyticus*, and *Bacillus megaterium*. 182. The formulation of any one of embodiments 163-181, wherein the one or more microbes comprises *Chryseobacterium lactis, Bacillus endophyticus*, and *Bacillus megaterium*. 183. The method of any one of embodiments 163-182, wherein the one or more microbes comprises *Ensifer adhaerens* and *Bacillus nakamurai* or *Bacillus subtilis*. 184. The formulation of any one of embodiments 163-183, wherein the one or more microbes comprises *Microbacterium yannicii* or *Microbacterium chocolatum*. 185. The formulation of any one of embodiments 163-184, wherein the one or more microbes comprises *Serratioa ureilytica* or *Serratioa marcescens*. 186. The formulation of any one of embodiments 163-185, wherein the one or more microbes comprises *Glutamicibacter arilaitensis* or *Glutamicibacter arilaitensis*. 187. The formulation of any one of embodiments 163-186, wherein the one or more microbes comprises *Ensifer adhaerens, Pantoea allii, Bacillus subtilis*, or *Bacillus subtilis*. 188. The formulation of any one of embodiments 163-187, wherein the one or more microbes comprise endospore forming microbes. 189. The formulation of any one of embodiments 163-188, wherein the one or more microbes comprises a *Bacillus* sp. 190. The formulation of any one of embodiments 163-189, wherein the one or more microbes is selected from the phyla Firmicutes, Proteobacteria, and Actinobacteria. 191. The formulation of any one of embodiments 163-190, wherein the one or more microbes is selected from the phylum Firmicutes. 192. The formulation of any one of embodiments 163-191, wherein the one or more microbes is selected from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoan-*

*aeromonas* sp., *Thermobacillus* sp., *Thermoflavimicrobium* sp., *Thermovenabulum* sp., *Tuberibacillus* sp., *Virgibacillus* sp. and *Vulcanobacillus* sp. 193. The formulation of any of embodiments 163-192, wherein the one or more microbes is selected from the phylum Proteobacteria. 194. The formulation of any one of embodiments 163-193, wherein the one or more microbes comprises *Actinomyces* sp. 195. The formulation of any one of embodiments 163-194, wherein the one or more microbes is selected from the phylum Actinobacteria. 196. The formulation of any one of embodiments 163-195, wherein the one or more microbes comprises *Coxiella* sp. 197. The formulation of any one of embodiments 163-196, wherein the one or more microbes form endospores after being incorporated into the seed. 198. The formulation of any one of embodiments 163-197, wherein the one or more microbes comprise endospores. 199. The formulation of any one of embodiments 163-198, wherein the one or more microbes comprise *Bacillus* endospores. 200. The formulation of any one of embodiments 163-199, wherein the one or more microbes comprise a 16S nucleic acid sequence of any of SEQ ID NOs:1-10221. 201. The formulation of any one of embodiments 163-200, wherein the one or more microbes comprise a 16S nucleic acid sequence at least 99% identical to that of any of SEQ ID NOs:1-10221. 202. The formulation of any one of embodiments 163-201, wherein the one or more microbes comprise a 16S nucleic acid sequence at least 98% identical to that of any of SEQ ID NOs:1-10221. 203. The formulation of any one of embodiments 163-202, wherein the one or more microbes comprise a 16S nucleic acid sequence at least 95% identical to that of any of SEQ ID NOs:1-10221. 204. The formulation of any one of embodiments 163-203, wherein the one or more microbes comprise a 16S nucleic acid sequence at least 90% identical to that of any of SEQ ID NOs:1-10221. 205. The formulation of any one of embodiments 163-204, further comprising a microbial exudate. 206. The formulation of any one of embodiments 163-205, wherein the microbial exudate contains one or more compounds that trigger Induced Systemic Tolerance (IST). 207. The formulation of any one of embodiments 163-206, wherein the microbial exudate contains one or more compounds that trigger Induced Systemic Resistance (ISR). 208. The formulation of any one of embodiments 163-207, wherein the microbial exudate contains one or more compounds that trigger plant development. 209. The formulation of any one of embodiments 163-208, wherein the microbial exudate is from a microbe comprising a 16S nucleic acid sequence of any of SEQ ID NOs:1-10221. 210. The formulation of any one of embodiments 163-209, wherein the microbial exudate is from a microbe comprising a 16S nucleic acid sequence at least 99% identical to that of any of SEQ ID NOs:1-10221. 211. The formulation of any one of embodiments 163-210, wherein the microbial exudate is from a microbe comprising a 16S nucleic acid sequence at least 98% identical to that of any of SEQ ID NOs:1-10221. 212. The formulation of any one of embodiments 163-211, wherein the microbial exudate is from a microbe comprising a 16S nucleic acid sequence at least 95% identical to that of any of SEQ ID NOs:1-10221. 213. The formulation of any one of embodiments 163-212, wherein the microbial exudate is from a microbe comprising a 16S nucleic acid sequence at least 90% identical to that of any of SEQ ID NOs:1-10221. 214. The formulation of any one of embodiments 163-213, wherein the concentration of the one or more microbes in the formulation is in the range of about $1\times10^3$ to $1\times10^{17}$ CFU/mL. 215. The formulation of any one of embodiments 163-214, wherein the concentration of the one or more microbes in the formulation is: $1\times10^3$ to $1\times10^4$ CFU/mL; $1\times10^4$ to $1\times10^5$ CFU/mL; $1\times10^5$ to $1\times10^6$ CFU/mL; $1\times10^6$ to $1\times10^7$ CFU/mL; $1\times10^7$ to $1\times10^8$ CFU/mL; $1\times10^8$ to $1\times10^9$ CFU/mL; $1\times10^9$ to $1\times10^{10}$ CFU/mL; $1\times10^{10}$ to $1\times10^{11}$ CFU/mL; $1\times10^{11}$ to $1\times10^{12}$ CFU/mL; $1\times10^{12}$ to $1\times10^{13}$ CFU/mL; $1\times10^{13}$ to $1\times10^{14}$ CFU/mL; $1\times10^{14}$ to $1\times10^{15}$ CFU/mL; $1\times10^{15}$ to $1\times10^{16}$ CFU/mL; or $1\times10^{16}$ to $1\times10^{17}$ CFU/mL.
216. A method of treating one or more plant seeds, the method comprising: (i) immersing the one or more seeds into a formulation, the formulation comprising a salt and one or more microbial exudates selected to produce a plant growth promoting effect; and (ii) incubating the one or more seeds in the formulation for a period of time sufficient to incorporate the one or more microbial exudates into the seed. 217. The method of embodiment 216, wherein the microbial exudate contains one or more compounds that trigger Induced Systemic Tolerance (IST). 218. The method of embodiment 216 or 217, wherein the microbial exudate contains one or more compounds that trigger Induced Systemic Resistance (ISR). 219. The method of any one of embodiments 216-218, wherein the microbial exudate contains one or more compounds that trigger plant development. 220. The method of any one of embodiments 216-219, wherein the microbial exudate is from a microbe comprising a 16S nucleic acid sequence of any of SEQ ID NOs:1-10221. 221. The method of any one of embodiments 216-220, wherein the microbial exudate is from a microbe comprising a 16S nucleic acid sequence at least 99% identical to that of any of SEQ ID NOs:1-10221. 222. The method of any one of embodiments 216-221, wherein the microbial exudate is from a microbe comprising a 16S nucleic acid sequence at least 98% identical to that of any of SEQ ID NOs:1-10221. 223. The method of any one of embodiments 216-222, wherein the microbial exudate is from a microbe comprising a 16S nucleic acid sequence at least 95% identical to that of any of SEQ ID NOs:1-10221. 224. The method of any one of embodiments 216-223, wherein the microbial exudate is from a microbe comprising a 16S nucleic acid sequence at least 90% identical to that of any of SEQ ID NOs:1-10221. 225. The method of any one of embodiments 216-224, wherein the salt comprises sodium chloride. 226. The method of any one of embodiments 216-225, wherein the salt is at a concentration of 0.1-0.2%, 0.2-0.3%, 0.3-0.4%, 0.4-0.5%, 0.5-0.6%, 0.6-0.7%, 0.7-0.8%, 0.8-0.9%, 0.9-1.0%, 1.0-1.1%, 1.1-1.2%, 1.2-1.3%, 1.3-1.4%, or 1.4-1.5%. 227. The method of any one of embodiments 216-226, wherein the salt is at a concentration of about 0.85%. 228. The method of any one of embodiments 216-227, wherein the salt is at a concentration of about 1.25% or less. 229. The method of any one of embodiments 216-228, wherein the salt is at a concentration of about 1.25%. 230. The method of any one of embodiments 216-229, wherein the microbial exudate is derived from *Microbacterium yannicii* or *Microbacterium chocolatum*. 231. The method of any one of embodiments 216-230, wherein the microbial exudate is derived from *Serratioa ureilytica* or *Serratioa marcescens*. 232. The method of any one of embodiments 216-231, wherein the microbial exudate is derived from *Glutamicibacter arilaitensis* or *Glutamicibacter halophytocola*. 233. The method of any one of embodiments 216-232, wherein the microbial exudate is derived from *Ensifer adhaerens*. 234. The method of any one of embodiments 216-233, wherein the microbial exudate is derived from *Chryseobacterium lactis*. 235. The method of any one of embodiments 216-234, wherein the microbial exudate is derived from *Acetobacter cerevisiae, Pantoea allii, Bacillus subtilis,* or

*Bacillus cucumis*. 236. The method of any one of embodiments 216-235, wherein the microbial exudate is derived from a microbe selected from the phyla Firmicutes, Proteobacteria, and Actinobacteria. 237. The method of any one of embodiments 216-236, wherein the microbial exudate is derived from a microbe selected from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp. and *Vulcanobacillus* sp. 238. The method of any one of embodiments 216-237, wherein the microbial exudate is derived from a microbe selected from the phylum Proteobacteria. 239. The method of any one of embodiments 216-238, wherein the microbial exudate is derived from *Actinomyces* sp. 240. The method of any one of embodiments 216-239, wherein the microbial exudate is derived from a microbe selected from the phylum Actinobacteria. 241. The method of any one of embodiments 216-240, wherein the microbial exudate is derived from *Coxiella* sp. 242. The method of any one of embodiments 216-241, wherein the microbial exudate is derived from a *Bacillus* sp.

242. A method of incorporating bacteria into a plant seed, the method comprising: a. contacting said plant seed with a solution containing said bacteria, wherein said solution comprises about 0.1% to about 2% of a salt (w/v); and b. incubating said plant seed with said solution thereby incorporating at least 1 colony forming unit (CFU) of said bacteria into said plant seed. 243. The method of embodiment 242, wherein (b) comprises incubating said plant seed with said solution thereby incorporating at least 500 CFU of said bacteria into said plant seed. 244. The method of embodiments 242 or 243, wherein said bacteria comprises endospore forming bacteria or endospores thereof 245. The method of any one of embodiments 242 to 244, wherein said solution comprises a microbial exudate. 246. The method of embodiment 245, wherein said microbial exudate is derived from said bacteria. 247. The method of embodiment 245, wherein said microbial exudate is not derived from said bacteria. 248. The method of any one of embodiments 242 to 247, wherein said bacteria comprise bacteria from the phyla Firmicutes, Proteobacteria, Actinobacteria, or a combination thereof 249. The method of any one of embodiments 242 to 248, wherein said bacteria comprise bacteria from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terri bacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp., or a combination thereof 250. The method of any one of embodiments 242 to 249, wherein said bacteria comprise bacteria from *Bacillus* sp. 251. The method of any one of embodiments 242 to 250, wherein said bacteria are incorporated between the seed coat and the embryo of said plant seed. 252. The method of any one of embodiments 242 to 251, further comprising, prior to (a), disinfecting said plant seed. 253. The method of any one of embodiments 242 to 252, wherein said solution comprises about 0.85% said salt. 254. The method of any one of embodiments 242 to 253, wherein said salt comprises NaCl. 255. The method of any one of embodiments 242 to 254, wherein said plant seed comprises a maize seed, wheat seed, rice seed, sorghum seed, barley seed, rye seed, sugar cane seed, millet seed, oat seed, soybean seed, cotton seed, alfalfa seed, bean seed, quinoa seed, lentil seed, peanut seed, lettuce seed, tomato seed, pea seed, or a cabbage seed. 256. The method of any one of embodiments 242 to 255, wherein said solution further comprises Luria-Bertani (LB) broth. 257. The method of any one of embodiments 242 to 256, wherein said solution further comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof 258. The method of any one of embodiments 242 to 257, wherein said solution further comprises calcium, magnesium, manganese, potassium, iron, or a combination thereof 259. The method of any one of embodiments 242 to 258, wherein said solution is maintained at a temperature between about 4° C. to about 40° C.; about 20° C. to about 40° C.; or about 10° C. to about 20° C. 260. The method of any one of embodiments 242 to 259, wherein said solution is maintained at about 23° C. or about 30° C. 261. The method of any one of embodiments 242 to 260, wherein said plant seed is incubated with said solution for about 1 minute to about 960 minutes, about 20 minutes to about 240 minutes, or about 1 minute to about 20 minutes. 262. The method of any one of embodiments 242 to 261, wherein said plant seed is incubated with said solution for about 1 minute, about 5 minutes, about 10 minutes, about 20 minutes, about 240 minutes, or about 960 minutes. 263. The method of any one of embodiments 245 to 262, further comprising inducing endosporulation of said endospore forming bacteria.

264. A modified plant seed comprising at least 1 CFU of bacteria incorporated between the seed coat and the embryo of said modified plant seed. 265. The modified plant seed of embodiment 264, wherein said modified plant seed comprises at least 500 CFU or at least 1000 CFU of said bacteria. 266. The modified plant seed of embodiment 264 or 265, wherein said bacteria comprises endospore forming bacteria or endospores thereof 267. The modified plant seed of any one of embodiments 264 to 266, wherein said modified plant seed comprises a microbial exudate. 268. The modified plant seed of embodiment 267, wherein said microbial exudate is derived from said bacteria. 269. The modified plant seed of embodiment 267, wherein said microbial exudate is not derived from said bacteria. 270. The modified plant seed of any one of embodiments 264 to 269, wherein said bacteria comprise bacteria from the phyla Firmicutes, Proteobacteria, Actinobacteria, or a combination thereof 271. The modified plant seed of any one of embodiments 264 to 270, wherein said bacteria comprise bacteria from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp., or a combination thereof 272. The modified plant seed of any one of embodiments 264 to 271, wherein said bacteria comprise bacteria from *Bacillus* sp. 273. The modified plant seed of any one of embodiments 264 to 272, wherein said modified seed is a maize seed, wheat seed, rice seed, sorghum seed, barley seed, rye seed, sugar cane seed, millet seed, oat seed, soybean seed, cotton seed, alfalfa seed, bean seed, quinoa seed, lentil seed, peanut seed, lettuce seed, tomato seed, pea seed, or cabbage seed. 274. The modified plant seed of any one of embodiments 264 to 273, wherein said plant seed comprises at least 1000 CFU of said microbe.

275. A formulation containing at least $1\times10^3$ CFU/mL of one or more bacteria wherein said formulation comprises about 0.1% to about 2% a salt. 276. The formulation of embodiment 275, comprising 0.85% said salt. 277. The formulation of embodiment 275 or 276, wherein said salt comprises NaCl. 278. The formulation of any one of embodiments 275 to 277, wherein said bacteria comprise endospore forming bacteria or endospores thereof 279. The formulation of any one of embodiments 275 to 278, wherein said formulation comprises a microbial exudate. 280. The method of embodiment 279, wherein said microbial exudate is derived from said bacteria. 281. The method of embodiment 279, wherein said microbial exudate is not derived from said bacteria. 282. The formulation of any one of embodiments 275 to 281, wherein said bacteria comprise bacteria from the phyla Firmicutes, Proteobacteria, or Actinobacteria. 283. The formulation of any one of embodiments 275 to 282, wherein said bacteria comprise bacteria from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp., or a combination thereof 284. The formulation of any one of embodiments 275 to 283, wherein said bacteria comprise bacteria from *Bacillus* sp. 285. The formulation of any one of embodiments 275 to 284, wherein said formulation further comprises LB broth. 286. The formulation of any one of embodiments 275 to 285, wherein said formulation further comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof 287. The formulation of any one of embodiments 275 to 286, wherein said formulation further comprises calcium, magnesium, manganese, potassium, iron, or a combination thereof 288. The formulation of any one of embodiments 275 to 287, wherein said formulation is maintained at a temperature between about 4° C. to about 40° C.; about 20° C. to about 40° C.; or about 10° C. to about 20° C. 289. The formulation of any one of embodiments 275 to 288, wherein said formulation is maintained at about 23° C. or about 30° C. 290. The formulation of any one of embodiments 275 to 289, wherein said formulation contains at least $5\times10^5$ CFU/mL of said bacteria.

291. A method of promoting a plant growth effect in a plant seed, the method comprising: a. contacting said plant seed with a solution containing bacteria, wherein said solution comprises about 0.1% to about 2% of a salt (w/v); and b. incubating said plant seed with said solution thereby incorporating at least 500 colony forming units (CFU) of said bacteria into said plant seed. 292. The method of embodiment 291, further comprising, prior to (a), disinfecting said plant seed. 293. The method of embodiment 291 or 292, wherein said bacteria comprises endospore forming bacteria or endospores thereof 294. The method of any one of embodiments 291 to 293, wherein said solution comprises a microbial exudate. 295. The method of embodiment 294, wherein said microbial exudate is derived from said bacteria. 296. The method of embodiment 294, wherein said microbial exudate is not derived from said bacteria. 297. The method of any one of embodiments 291 to 296, wherein said bacteria are incorporated between the seed coat and the embryo of said modified plant seed. 298. The method of any one of embodiments 291 to 297, wherein said solution comprises about 0.85% said salt. 299. The method of any one of embodiments 291 to 298, wherein said salt comprises NaCl. 300. The method of any one of embodiments 291 to 299, wherein said bacteria comprise bacteria from the phyla Firmicutes, Proteobacteria, Actinobacteria, or a combination thereof 301. The method of any one of embodiments 291 to 300, wherein said bacteria comprise bacteria from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Plamfilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp., or a combination thereof 302. The method of any one of embodiments 291 to 301, wherein said bacteria comprise bacteria from *Bacillus* sp. 303. The method of any one of embodiments 291 to 302, wherein said plant seed comprises a maize seed, wheat seed, rice seed, sorghum seed, barley seed, rye seed, sugar cane seed, millet seed, oat seed, soybean seed, cotton seed, alfalfa seed, bean seed, quinoa seed, lentil seed, peanut seed, lettuce seed, tomato seed, pea seed, or a cabbage seed. 304. The method of any one of embodiments 291 to 303, wherein said solution further comprises LB broth. 305. The method of any one of embodiments 291 to 304, wherein said solution further comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof 306. The method of any one of embodiments 291 to 305, wherein said solution further comprises calcium, magnesium, manganese, potassium, iron, or a combination thereof 307. The method of any one of embodiments 291 to 306, wherein said solution is maintained at a temperature between about 4° C. to about 40° C.; about 20° C. to about 40° C.; or about 10° C. to about 20° C. 308. The method of any one of embodiments 291 to 307, wherein said solution is maintained at about 23° C. or about 30° C. 309. The method of any one of embodiments 291 to 308, wherein said plant seed is incubated with said solution for about 1 minute to about 960 minutes, about 20 minutes to about 240 minutes, or about 1 minute to about 20 minutes. 310. The method of any one of embodiments 291 to 309, wherein said plant seed is incubated with said solution for about 1 minute, about 5 minutes, about 10 minutes, about 20 minutes, about 240 minutes, or about 960 minutes. 311. The method of any one of embodiments 291 to 310, further comprising inducing endosporulation of said endospore forming bacteria. 312. The method of any one of embodiments 291 to 311, wherein said plant growth effect comprises yield increase, cell osmoregulation, ionic homeostasis, antioxidant defense, heat stress tolerance, maintenance of photosynthetic capacity, nitrogen fixation, or a combination thereof 313. The method of embodiment 312, wherein said bacteria are selected relative to said plant growth effect.

314. A method of promoting a plant growth effect in a plant seed, the method comprising: a. contacting said plant seed with a solution containing a microbial exudate, wherein said solution comprises about 0.1% to about 2% of a salt (w/v); and b. incubating said plant seed with said solution thereby incorporating said microbial exudate into said plant seed. 315. The method of embodiment 314, further comprising, prior to (a), disinfecting said plant seed. 316. The method of embodiment 314 or 315, wherein said microbial exudate is derived from endospore forming bacteria or endospores thereof 317. The method of embodiment 314 or 315, wherein said microbial exudate is derived from non-endospore forming bacteria. 318. The method of any one of embodiments 314 to 317, wherein said microbial exudate is incorporated between the seed coat and the embryo of said modified plant seed. 319. The method of any one of embodiments 314 to 318, wherein said solution comprises about 0.85% said salt. 320. The method of any one of embodiments 314 to 319, wherein said salt comprises NaCl. 321. The method of any one of embodiments 314 to 320, wherein said microbial exudate is derived from bacteria from the phyla Firmicutes, Proteobacteria, Actinobacteria, or a combination thereof 322. The method of any one of embodiments 314 to 321, wherein said microbial exudate is derived from bacteria from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfurispora* sp., *Filifactor* sp., *Filobacillus* sp., *Gelria* sp., *Geobacillus* sp., *Geosporobacter* sp., *Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp., or a combination thereof 323. The method of any one of embodiments 314 to 322, wherein said microbial exudate is derived from bacteria from *Bacillus* sp. 324. The method of any one of embodiments 314 to 323, wherein said plant seed comprises a maize seed, wheat seed, rice seed, sorghum seed, barley seed, rye seed, sugar cane seed, millet seed, oat seed, soybean seed, cotton seed, alfalfa seed, bean seed, quinoa seed, lentil seed, peanut seed, lettuce seed, tomato seed, pea seed, or a cabbage seed. 325. The method of any one of embodiments 314 to 324, wherein said solution further comprises dimethyl sulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan, Poloxamer 188, Poloxamer 237, Poloxamer 338, Poloxamer 407, or a combination thereof 326. The method of any one of embodiments 314 to 325, wherein said solution is maintained at a temperature between about 4° C. to about 40° C.; about 20° C. to about 40° C.; or about 10° C. to about 20° C. 327. The method of any one of embodiments 314 to 326, wherein said solution is maintained at about 23° C. or about 30° C. 328. The method of any one of embodiments 314 to 327, wherein said plant seed is incubated with said solution for about 1 minute to about 960 minutes, about 20 minutes to about 240 minutes, or about 1 minute to about 20 minutes. 329. The method of any one of embodiments 314 to 328, wherein said plant seed is incubated with said solution for about 1 minute, about 5 minutes, about 10 minutes, about 20 minutes, about 240 minutes, or about 960 minutes. 330. The method of any one of embodiments 314 to 329, wherein said plant growth effect comprises plant yield increase, cell osmoregulation, ionic homeostasis, antioxidant defense, heat stress tolerance, maintenance of photosynthetic capacity, nitrogen fixation, or a combination thereof 331. The method of any one of embodiments 314 to 330, wherein said microbial exudate is selected relative to said plant growth effect. 332. The method of any one of embodiments 314 to 331, wherein said plant growth effect comprises nitrogen fixation. 333. The method of any one of embodiments 314 to 331, wherein said plant growth effect comprises plant yield increase.

334. The engineered seed of any one of embodiments 1 to 55, the one or more microbes are selected to improve plant yield.

335. The method of any one of embodiments 57-161, wherein plant growth effect comprises yield increase.

336. The method of any one of embodiments 291 to 312, wherein said plant growth effect comprises yield increase.

EXAMPLES

The methods and compositions of the disclosure are designed to enhance growth, nutritional status, and tolerance to environmental and biotic stresses of an agricultural plant, or an agricultural grass plant, derived from a seed, by treating the seed with plant beneficial microorganisms and/or its exudates and/or its individualized biomolecules, while in the dormant stage. The Microprime™ seed treatment will allow biological priming of the seed embryo. At this stage, bacteria and/or endospores and exudates previously incorporated within the seed are most conveniently positioned to access the plant embryo and stimulate an enduring plant development and/or induce tolerance response in the plant host and at the same time, in the case of using bacteria, advantage is given for successful colonization of the root niche before the root is exposed to the soil microbiota. For example, achieving an effective root niche colonization by nitrogen fixing bacteria will allow efficient delivery of ammonium to the plant.

Definition of the microbial formulation: In order to achieve early conditioning, the disclosure employs seed treatment compositions comprising a synthetic consortium or single isolated bacterial strains or endospores in a suspension medium. Typically, the plant cultivation compositions and methods comprise diverse and environmentally adaptable plant-associated bacteria belonging to a wide variety of bacterial genera, distributed among different taxa within the Proteobacteria phylum α-, β-, γ and δ-Proteobacteria classes), as well as the Phylum Firmicutes, Bacteroidetes, and Actinobacteria. The inventors have isolated and characterized plant growth-promoting bacteria belonging to various genera, usually comprising plant associated microorganisms, within these large taxonomical groups can be applied to seeds, using the method of the present disclosure, in order to improve plant growth and health. Compositions include one, two, three, or several different bacterial strains cultivated separately, and mixed for Microprime™ seed treatment.

Example 1. Seed Treatment to Increase Loading of Non-Endospore-Forming Bacteria, Endospore-Forming Bacteria and/or Bacteria Endospores: The Microprime™ Technology The concept of loading bacteria and bacteria endospores inside the seed is illustrated in FIG. 1. A process that can be carried out at room temperature and in a short period of time will always be desirable since it will be industrially scalable and more economical as it will use less resources and energy. Several surfactants or agents have been explored in order to streamline the process of incorporation of the microorganisms into the seed at room temperature. Among surfactants that may improve the seed permeability and entering of the desired elements into the seed by themselves or in combination are dimethylsulfoxide (DMSO), 1-dodecylazacycloheptan-2-one, laurocapram, 1-methyl-2-pyrrolidone (NMP), oleic acid, ethanol, methanol, polyethylene glycol (Brij 35, 58, 98), polyethylene glycol monolaurate (Tween 20), Tween 40 (Polyoxyethylenate sorbitol ester), Tween 60, Tween 80 (non-ionic), cetylmethylammonium bromide (CTAB), urea, lecithins (solidified fatty acids derived from soybean), chitosan and different poloxamers (188, 237, 338, 407). Below is a summary table (Table 2) of tests performed with a 0.85% w/v NaCl salt in the medium supplemented with two selected surfactants or agents (Tween 20 and Poloxamer 188). The treatment was carried out at 23° C. for 5 minutes with a strain of *Serratia* sp., in commercial corn seeds (Dekalb DK630). The concentration of cells in the Microprime™ solution was $6.4 \times 10^9$ CFU/ml.

TABLE 2

| Condition | CFU/seed 0.85% NaCl |
|---|---|
| Saline solution | 7.9.E+05 |
| Saline solution + Tween 20 | 6.2.E+05 |
| Salinesolution + Poloxamer | 1.2.E+06 |

The addition of Poloxamer 188 (0.1% w/v) to the Microprime™ solution increased a 52% the loading of bacteria inside the seed. This effect of a large increase of bacterial cells within the seed (while maintaining during the Microprime™ seed treatment process the parameters of ambient temperature and a short imbibition time) are highly desirable due to its industrial scale implementation.

The results of the same previous test are presented below in table 3, but with a higher concentration of NaCl (1.25% w/v) in the Microprime™ solution, and with a cell concentration of $2.9 \times 10^{12}$ CFU/ml.

TABLE 3

| Condition | CFU/seed 1.25% NaCl |
|---|---|
| Salinesolution | 3.9.E+05 |
| Saline solution + Tween 20 | 7.1.E+05 |
| Salinesolution + Poloxamer | 6.3.E+05 |

When comparing both results, it is evident that the effect of both, Tween 20 and Poloxamer 188 continue to help towards the incorporation of more bacterial cells into the seed when compared to the same imbibition media without these surfactants. The efficiency of incorporating the bacterial cells into the seeds decrease dramatically when 1.25% (w/v) NaCl was used.

In order to lower standard deviation and standard error of the number of bacterial cell present inside the treated seeds, we add a nutrient (in the following example the same Luria-Bertani (LB) medium used for growing the bacteria previous to incorporating them into the Microprime™ solution). In table 4 is shown that adding a nutritional source for the bacteria, a decrease in the standard deviation and standard error may be achieve, and by consequence a more homogeneous number of bacterial cells can be achieved inside the seeds.

TABLE 4

| | Treatments assays (CFU/Seed Average) | | | Assays Average | Assays Standard Deviation | Standard Error |
|---|---|---|---|---|---|---|
| | 1 | 2 | 3 | | | |
| NaCl 0.85% | 1,160,000 | 183,000 | 750,000 | 697,667 | 490,598 | 283,247 |
| LB NaCl 0.85% | 830,000 | 718,000 | 375,000 | 641,000 | 237,072 | 136,873 |

The lower standard deviation and standard error when the imbibition media is supplemented with a nutritional source for the bacteria may be explained because once bacteria are located inside the seed they can continue proliferating by having access to these nutrients until the nutrients are depleted or until the viable growth conditions for the bacteria are stopped (for example when the seeds are dried).

Among supplements that may improve the conversion of endospore-forming bacteria from its vegetative stage to an endospore are calcium, magnesium, potassium, manganese and ferrous sulfate, by themselves or in combination. In table 5 is reported the number of endospores per milliliter obtained under different media containing minerals and different times of incubation of a *Bacillus* sp. isolate.

TABLE 5

| Treatment | Incubation time (h) | | |
|---|---|---|---|
| Incubation medium | 24 | 48 | 72 |
| LB | | 22 | 490 | 290 |
| LB + Ca | | | 2,650 |
| LB + Mg | | | 8,050 |
| LB + Mn | 43,500 | 1,605,000 | 8,700,000 |
| LB + Ca + Mg + Mn | 165,000 | 1,830,000,000 | 5,100,000,000 |

For an adequate proliferation of the bacteria loaded into the seed, it is necessary to supplement the Microprime™ solution with nutrients of particular compatibility with the selected bacterium, or alternatively, directly add to the Microprime™ solution endospores of the desired bacterium to be incorporated into the seed.

The loading of a desired bacterium, endospore or a bacterial consortium into a dicot or a monocot seed is a complex and nonlinear process. As shown in table 6 and in the case of a monocot seed (maize, *Zea mays*), the success of loading a desired amount of endospore of a *Bacillus* sp. isolate with an in planta effect has an inflection point in terms of the initial minimal concentration of endospores in the Microprime™ solution after which the cells can effectively be loaded into the seed.

FIG. 5 shows the loading kinetics into a dicot seed (lettuce, *Lactuca sativa*) of a synthetic bacterial consortium internally denominated Lascar, composed of four bacterial isolates. This result confirms that the bacterial loading process by a Microprime™ seed treatment does not follow a linear behavior and that there is an initial minimum concentration of Colony Forming Unit (CFU) per milliliter in the Microprime™ solution that must be met to achieve an efficient load of bacteria into the seed. Also, these kinetics curves show that a saturation point exists, and it is near 1.00E+5 CFU per seed. In turn, it can be observed that the loading kinetics and the initial minimum concentration is not generalizable and depends on the bacterium's type.

TABLE 6

| CFU/ml | Average of CFU/seed |
|---|---|
| 1.00E+08 | 1.56E+04 |
| 1.00E+06 | ≤20 |
| 1.00E+04 | ≤20 |
| 1.00E+02 | ≤20 |

The duration of the Microprime™ seed treatment process is key to industrial scaling. Co-culture time was evaluated using vegetative cells and endospores of two different bacteria, as shown in table 7. The seeds are externally sterilized, dried for 24 hours, ground and later the average Colony Forming Unit (CFU) within the seed is quantified. Three biological replicates consisting in pools of three seeds each were used for the quantification of CFU/seed. In all cases, exposures of at least 5 minutes is enough to load thousands of bacterial cells, with the exception of the vegetative cell of strain S3C23. The maximum load is achieved over 20 minutes in all cell types.

TABLE 7

Example of loading yields vs time of Microprime ™ seed treatment process.

| Strain | Type of cell | Time (min) | Average of CFU/seed |
|---|---|---|---|
| S3C10 | Vegetative | 5 | 8.20E+03 |
| | | 10 | 6.04E+03 |
| | | 20 | 2.49E+04 |
| | | 240 | 2.18E+05 |
| | | 960 | 5.00E+04 |
| S3C23 | Endospore | 20 | 4.10E+03 |
| | | 60 | 3.02E+03 |
| | | 120 | 2.82E+04 |
| | | 240 | 1.09E+05 |
| S3C23 | Vegetative | 5 | 2.00E+01 |
| | | 10 | 4.45E+03 |
| | | 20 | 5.80E+04 |

Example 2. Visualization of Microprime™ Seed Treatment Through Fluorescent Bacteria For assessing the spatial distribution of loaded bacteria inside the seed, an *Escherichia coli* fluorescent reporter strain was used. Maize seeds (Dekalb DK630) were treated with Microprime™ using a *E. coli* expressing constitutively a Red Fluorescent Protein. The colony-forming units per seed was 1.99E+5 and the Microprime™ treatment conditions were 240 min (4 h.) at 37° C. Seeds were fixed and cut in 0.5 cm long sections. The samples were then analyzed under a confocal microscope with a wavelength of 558 nm. Bacteria loading and localization was confirmed visually (pink filaments, FIG. 4A). A closer observation shows that bacteria is placed specifically in the interspace between the seed pericarp and the seed aleurone cells layer, which separates the endosperm and embryo from outer layers (FIG. 4B).

These results indicate that a Microprime™ seed treatment can effectively load bacteria inside the seed, and for the case of monocots seeds, in the interspace between the seed pericarp and the seed aleurone cells layer.

Figure 6:
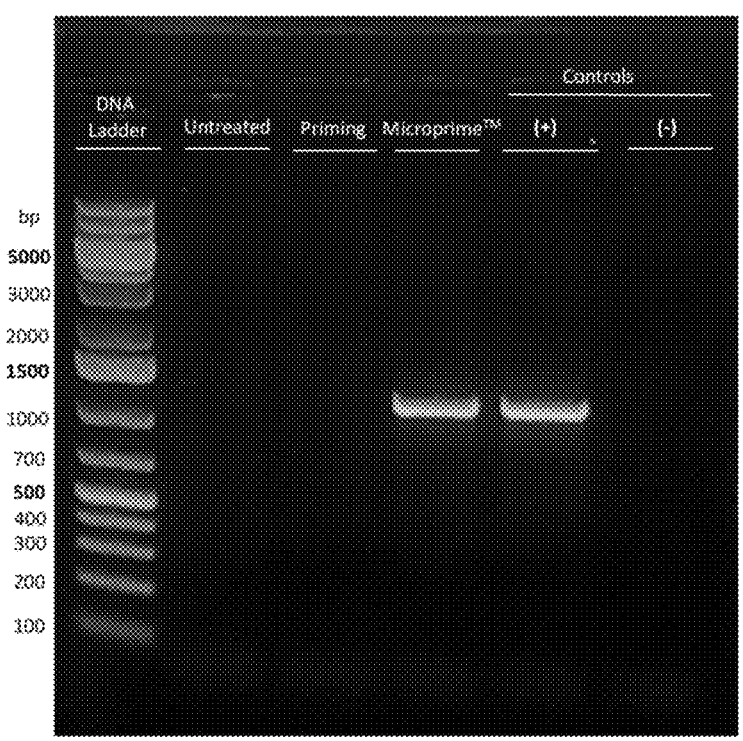
FIG. 6 shows the molecular detection on roots of maize plants (*Zea mays*) of a specific strain previously loaded into the seed by Microprime™ seed treatment

Example 3. Specific Bacteria Seed Loading Efficiency by Microprime™ Seed Treatment Process The Microprime™ seed treatment process involves the imbibition of seeds into a well-defined liquid solution containing the specific bacteria for a period of time sufficient to allow the loading of the bacteria into the seed. It is necessary to know the efficiency of this process, that means which is the percentage of seeds that are capable of being loaded with bacteria. To identify this value, we design specific DNA primers that allow us to detect the bacteria at a molecular level by using PCR technique as shown in FIG. 6. Maize seeds (Dekalb DK630) with Microprime™ seed treatment using a bacterial isolate, *Ensifer adhaerens*, internally denominated strain S3C10, were germinated in vitro using culture tubes with 3 ml of Murashige and Skoog liquid medium. After the plant root emerges from the seed (3 to 5 days after sowing), a quick DNA extraction procedure was performed from liquid medium and a PCR reaction was carried out using the specific primers as is shown in the FIG. 6. Priming seeds (seeds treated under same conditions and formulation but excluding bacteria) were used as a control. The Colony Forming Units per seed was 6.53E+4 and the Microprime™ seed treatment conditions were 20 minutes at 23° C.

Table 8 shows the percentage of seeds where is possible detect by PCR the loaded bacteria. The efficiency of loading seeds by Microprime™ seed treatment is about 98%.

TABLE 8

| Treatment | Total No of seeds sampled | No of seeds with PCR positive | Efficiency (%) |
|---|---|---|---|
| Priming | 30 | 0 | 0 |
| Microprime ™ | 90 | 88 | 98 |

Figure 7:
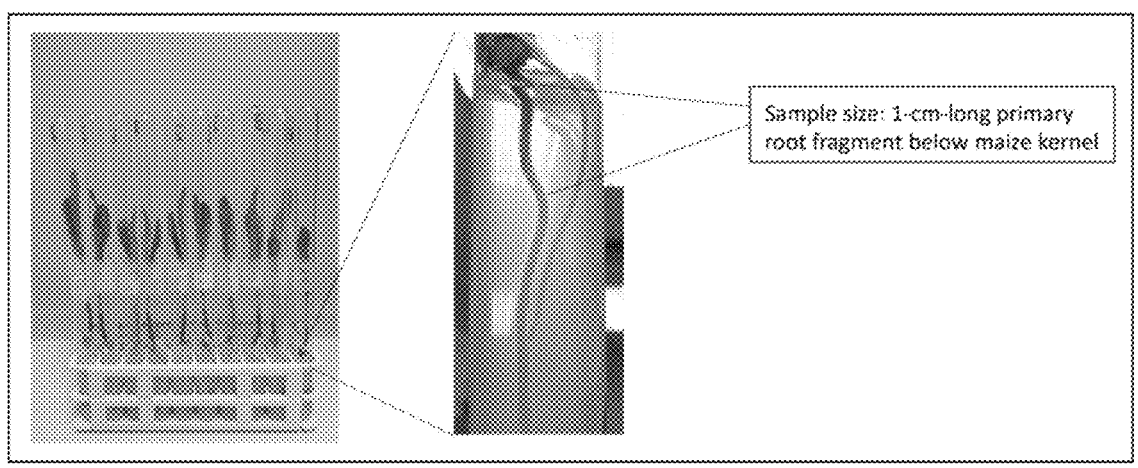
FIG. 7 shows the double-tube growth chamber used to study and quantify bacteria from Microprime™ seeds.
Figure 8:
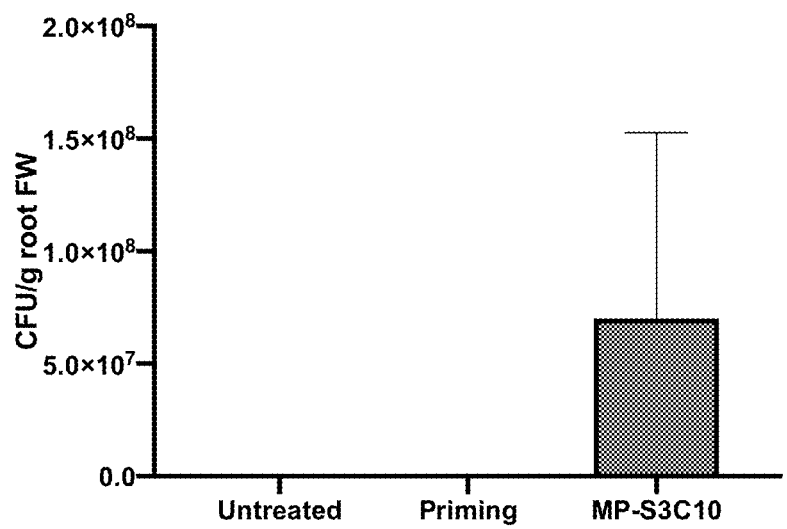
FIG. 8 shows the quantification of the colonization of plant root by bacteria loaded into the seed by Microprime™ seed treatment.

Example 4. Colonization of Plant Root by Bacteria Loaded into the Seed by Microprime™ Seed Treatment Maize seeds (Dekalb DK630) treated with Microprime™ and the bacterial isolate, *Ensifer adhaerens* (S3C10) were grown in a double-tube growth chamber using agar as a substrate, as is shown in FIG. 7, according to methods described in Niu et al., 2018. This protocol has been developed to set up a gnotobiotic system for cultivating maize seedlings colonized by the root-associated simplified communities. Untreated seeds (non-treated and non-inoculated seeds), Priming seeds (treated and non-inoculated seeds) and Microprime™ seeds (treated and inoculated) were directly germinated in double-tube chambers under the following conditions: 16 hours of light (day) and 8 hours of dark (night), 25° C. and a relative humidity of 54%. The maize seedlings were kept under the above conditions for 15 days. After this time, a 1-cm-long primary root fragment below maize kernel was harvest from the germinated seed by cutting the primary root with a sterile scalpel blade. Then the root fragment was weight in a balance, rinsed in sterile 1×PBS buffer and ground by sterile pistils. The mixed bacterial suspension was serially diluted and plated in LB agar. The quantification of colony-forming units (CFU) per gram of roots is shown in FIG. 8 for each treatment (n=15). Under these experimental conditions, CFU is not detectable in roots of untreated and priming seedlings. Instead, a mean of 7.00E+7 CFU/gram of root is detected in seedlings of Microprime™ seed, indicating that bacteria loaded into the seed is capable to effectively colonize the plant root structure after germination.

Figure 9:
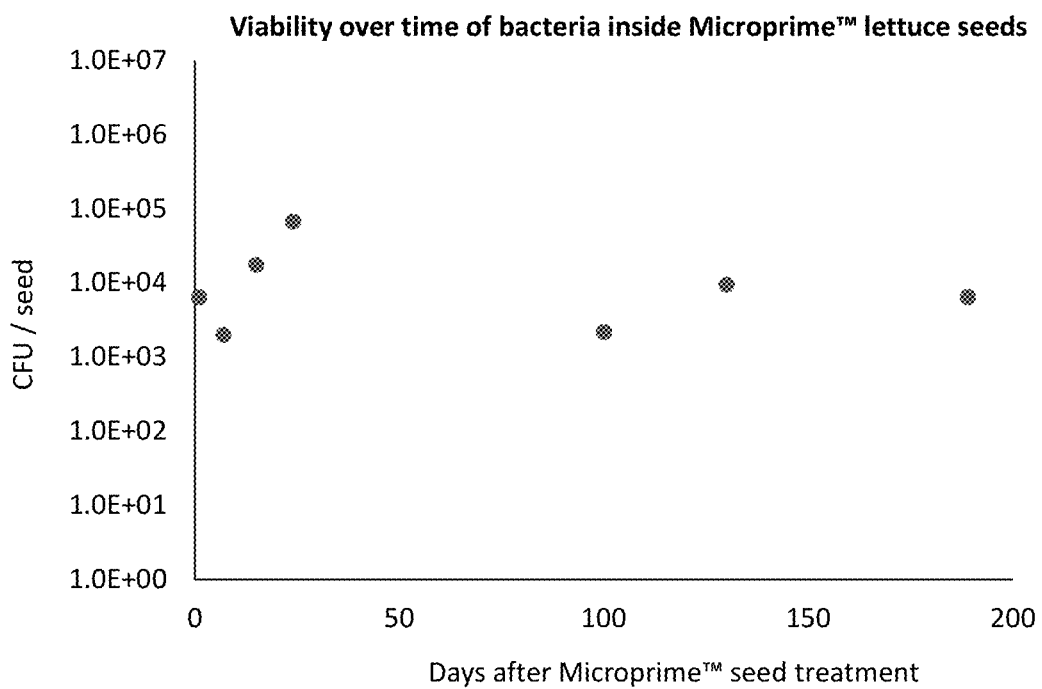
FIG. 9 shows the temporal stability of a bacterial consortium housed inside lettuce seeds (*Lactuca sativa*).

Example 5. Temporal Stability of Bacteria Loaded into the Seeds by Microprime™ Seed Treatment In order for a bacteria seed treatment technology to be compatible with traditional seed industry logistics and be of value to farmers, it will require that the bacteria stability, understood as the viability of the bacteria inside the seed can be guaranteed for months (typical seed industry logistics involve the storage of seeds for months or even years until it's sowed/planted by the farmer). To evaluate bacterial stability after a Microprime™ seed treatment, lettuce and maize seeds were treated under a Microprime™ seed treatment process with a bacterial consortium named internally Lascar and with endospores of a bacterial isolate, *Bacillus subtilis*, internally denominated strain S3C23, respectively. Specific bacteria Colony Forming Unit (CFU) was assessed through time of stored Microprime™ treated seeds. In both cases, triplicate pools of seeds were ground at different times upon treatment and CFU per seed was recorded. The colony-forming units per seed in MP-S3C23 seeds was 7.10E+3 and the Microprime™ seed treatment conditions were 20 minutes at 23° C. The FIG. 9 shows the survival of the bacterial consortium Lascar in Microprime™ lettuce seeds at short-times (less than 50 days) and long-time (over 100 days).

Figure 10:
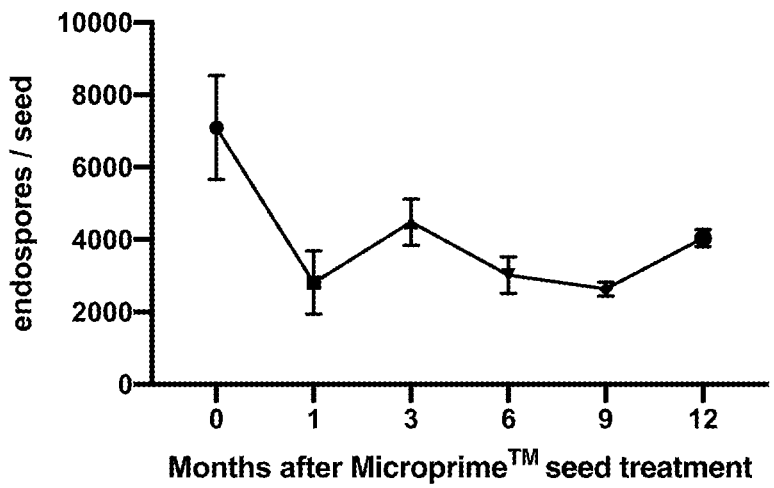
FIG. 10 shows the temporal stability of an endospore of *Bacillus* housed inside maize seeds (*Zea mays*).

In addition, FIG. 10 shows the survival of endospores of strain S3C23 inside maize seed in a period of time between 1 and 12 months after Microprime™ seed treatment.

Both results demonstrate a-seed bacteria shelf-life compatible with the requirements of traditional seed industry and agricultural practices.

Example 6. Temporal Stability of the Plant Embryo in Microprime™ Treated Seeds

Osmotic or water-based seed treatments considerably affect the embryo viability and germination through time, and through time also decreases the seed vigor, which determines the potential of a rapid and uniform emergence of plants. To show how Microprime™ seed treatment doesn't negatively affect the germination rate and seed vigor, tomato, lettuce and maize seeds were analyzed in different times. Table 9 shows the effect in vigor of the Microprime™ seed treatment and the conventional seed priming treatment (also known as osmopriming) on tomato (*Solanum lycopersicum*) embryo (Tomato Ferry-Morse cv. Roma VF). The percentage of emergence of 36 plants per treatment was measured seven days after sowing in peat: perlite (used as soil substrate). The growth conditions were 25° C., 54% humidity and a 16 h/8 h (light/dark hours). The Microprime™ seed treatment was performed with a bacterial isolate, *Pantoea allii*, internally denominated strain P9C1 and two different imbibition media solutions (sol. 1 and sol. 2). Sol. 1 had only the bacterium and sol. 2 had the bacterium and its exudates. The Colony Forming Units per seed in MP-P9C1 soli seeds was 2.00E+5 and for MP-P9C1_sol.2 was 5.00E+5. The Microprime™ seed treatment conditions were 240 minutes (4 hours) at 30° C. Control seeds did not have any treatment. Priming seeds were treated with the same two imbibition media sol. 1 and sol. 2 but without bacterium (basically an osmopriming seed treatment).

As is well-known, after a priming process where the seeds are imbibed into a liquid solution (osmotically or not), the vigor of the plant embryo will be negatively affected through time. With the Microprime™ seed treatment the vigor of plant embryo remains similar to an untreated seed, as is shown in the following table (Table 9).

TABLE 9

| Treatment | % of seedling emergence |
| --- | --- |
| Untreated | 83.3 |
| Priming_Sol.1 | 66.7 |
| MP-P9C1_Sol. 1 | 88.9 |
| Priming_Sol. 2 | 63.9 |
| MP-P9Cl_Sol. 2 | 86.1 |

Figure 11:
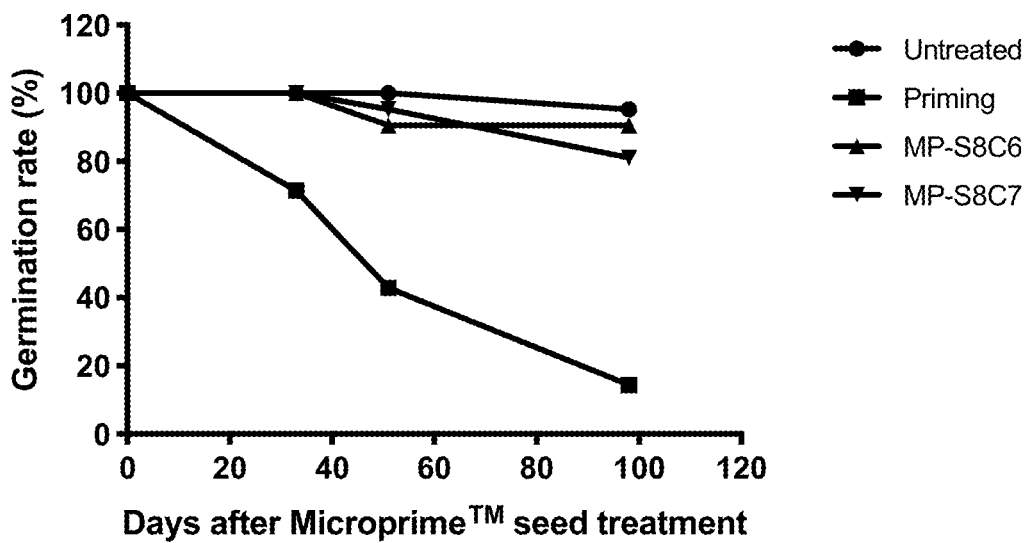
FIG. 11 shows the temporal stability of maize seeds (*Zea mays*) after a Microprime™ seed treatment.

FIG. 11 shows the germination rate of maize (*Zea mays*) seeds with a Microprime™ seed treatment (Microprime™ seeds) using two bacterial isolates, *Serratia marcescens* and *Glutamicibacter halophytocola*, internally denominated S8C6 and S8C7, respectively. The germination rate of 21 maize seeds (non-GMO DK630 from Dekalb) was measured through several storage times including 0, 33, 51 and 98 days after Microprime™ seed treatment. Control seeds did not have any treatment. Priming seeds were treated with the same imbibition media as Microprime™ seeds but without bacteria (basically an osmopriming seed treatment). The results indicate that seeds treated with Microprime™ show the same germination rate than control/untreated seeds and both are significantly higher than primed seeds (FIG. 11).

In addition, the germination rate of lettuce (*Lactuca sativa*) seeds with a Microprime™ seed treatment containing a synthetic consortium of bacteria, internally denominated JIT, was evaluated. The JIT consortium consist of bacterium 4 (*Chryseobacterium lactis*), bacterium 5 (*Bacillus endophyticus*), and bacterium 6 (*Bacillus megaterium*). The germination rate of lettuce seeds after 240 days from seed treatments is shown on the following table (Table 10).

TABLE 10

| Treatment | Germination rate (%) |
| --- | --- |
| Untreated | 93.3 |
| Priming | 86.7 |
| Microprime ™ -JIT (MP-JIT) | 97.8 |

Number of seeds per treatment = 30

These results indicate that Microprime™ seed treatment do not affect the germination rate and seed vigor during the normal aging of tomato, lettuce and maize seeds being compatible with a commercial product.

To validate if Microprime™ treatment will affect the seed vigor in long-term storage time, an accelerated aging (AA) test was performed in Microprime™ (MP) maize seeds (Dekalb DK630). The AA test provides valuable information on storage and seedling field emergence potentials. Twenty corn seeds of each lot or treatment were subjected to 43° C. for 72 h. and approximately 95% of relative humidity. After AA treatment, seeds were sown in peat:perlite soil and incubated in a greenhouse with a temperature of 25° C., humidity 54% and photoperiod of 16 hours of light and 8 hours of dark. Seven days after sowing the emergence of the hypocotyl, and the number of normal, abnormal and dead seedlings were measured. Control seeds did not have any treatment. Priming seeds were treated with a Microprime™ solution without bacteria (basically seed osmopriming treatment), MP-S3C10+S3C23 seeds were treated with a Microprime™ solution containing the synthetic consortium comprising the two bacterial isolates, *Ensifer adhaerens* (S3C10) and *Bacillus subtilis* (S3C23) and MP-S8C7 seeds were treated with a Microprime™ solution including the bacterial isolate *Glutamicibacter halophytocola*, internally denominated strain S8C7. The Colony Forming Units (CFU) per seed of strain S3C10 was 2.20E+3, 5.00E+1 for strain S3C23 and 1.98E+4 for strain S8C7. The Microprime™ seed treatment conditions were 10 minutes at 30° C.

The results of AA test are shown in the following table (Table 11).

TABLE 11

| Treatment | Normal seedlings | AA Germination (%) | Vigor |
|---|---|---|---|
| Untreated | 19 | 95 | High |
| Priming | 1 | 5 | Low |
| MP-S8C7 | 20 | 100 | High |
| MP-S3C10 + S3C23 | 19 | 95 | High |

*Standard scale of AA germination: ≥80% = high vigor; 60-80% = medium vigor; ≤60% = low vigor.

The results illustrated in FIG. 11, together with table 9, table 10 and table 11 indicates that Microprime™ seed treatment doesn't affect the germination rate, embryo viability and seed vigor through time, making it highly compatible with a commercial product (Microprime™ seeds).

Example 7. Microprime™ Seed Treatment Effect in Lettuce Growth and Development

Figure 12:
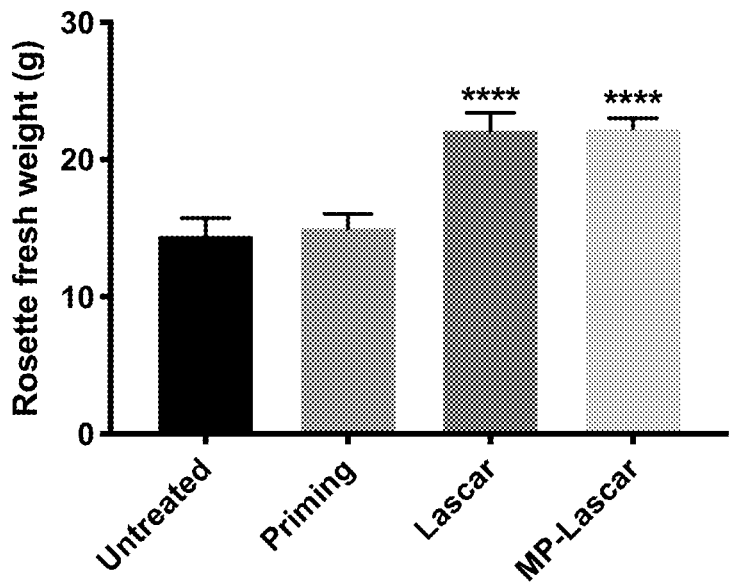
FIG. 12 shows the effect on lettuce seeds (*Lactuca sativa*) of Microprime™ seed treatment using a proprietary composition of bacteria, internally denominated Lascar.

One of the main goals of introducing microorganism inside the seed is to achieve an efficient bacterial delivery method that improvement a desired agricultural trait such as growth enhancement and field performance. In order to evaluate the effect in plants, the growth and development of lettuce plants growing from Microprime™ seeds were tested. In FIG. 12 is shown the effect of a proprietary composition of bacteria, internally denominated Lascar in lettuce seeds (*Lactuca sativa*). The Lascar consortium consists of bacterium 1 (*Acetobacter* cereviseae), bacterium 4 (*Chryseobacterium lactis*), bacterium 5 (*Bacillus endophyticus*), and bacterium 6 (*Bacillus megaterium*). The rosette fresh weight of lettuce (*Seminis* brand cv. Mohawk) was measured 67 days after sowing in plants growing from Microprime™ seeds (MP-Lascar), plants growing from seeds inoculated with Lascar as a liquid form (Lascar), plants growing from seeds treated with the imbibition solution without bacteria (Priming) and plants growing from seeds without any treatment (Untreated). The treatment named Lascar is a positive control corresponding to a synthetic consortium which is applied externally to the seeds prior to sowing as is performed with typical microbial technology application. The treatment named Priming is a negative control treatment which consists of the imbibition solution without the bacterial consortium. Bars are means±1 standard error of at least 15 plants per treatment. Asterisks represent statistically significant differences (one-way ANOVA, p-value <0.05; Dunnett's multiple comparisons test, p-value <0.05). The assay was performed in greenhouse, peat:perlite soil as substrate, in a growth period of 67 days. Growth temperature was 19° C., humidity 54% and the photoperiod was of 16 hours of light and 8 hours of dark.

This result indicated that a Microprime™ seed treatment with Lascar consortium increases the lettuce vegetative growth as much as a traditional inoculation by liquid form (FIG. 12). However, the advantages of this new delivery system (Microprime™ seeds) are several, ranging from commercial (scalability, long-term storage) to operational issues (a product easy to use by farmers, reduction of probability of contamination) and thus lowering the technological risk of using beneficial microorganisms in the field.

Figure 13:
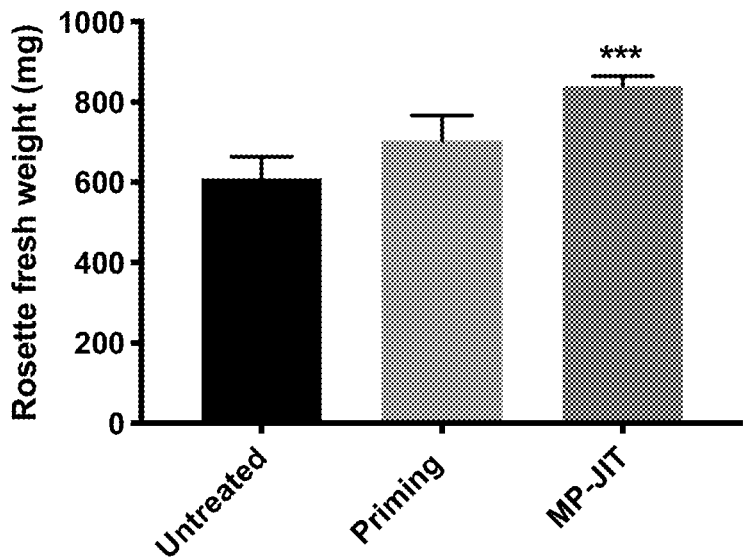
FIG. 13 shows the effect in time of the Microprime™ seed treatment on lettuce seeds (*Lactuca sativa*) using a proprietary composition of bacteria, internally denominated JIT.

The storage effect on lettuce seeds treated with Microprime™ was evaluated using a proprietary composition of bacteria, internally denominated JIT. The JIT consortium consists of bacterium 4 (*Chryseobacterium lactis*), bacterium 5 (*Bacillus endophyticus*), and bacterium 6 (*Bacillus megaterium*). FIG. 13 shows the fresh weight of lettuce Harris Moran cv. Desert Storm 28 days after sowing seeds with 60 days of storage of the following treatments: MP-JIT (treated and inoculated), Priming (treated and non-inoculated) and Untreated. The treatment named Priming is a negative control seed with a treatment consisting in the imbibition of the same in a solution without the bacterial consortium. Bars are means±1 standard error of at least 15 plants per treatment. Asterisks represent statistically significant differences (Kruskal Wallis, p-value <0.05; Dunn's multiple comparisons test, p-value <0.05). The assay was performed in greenhouse, peat:perlite soil as substrate and a growth period of 28 days. Growth temperature was 19° C., humidity 54% and the photoperiod of 16 hours of light and 8 hours of dark.

Figure 14:
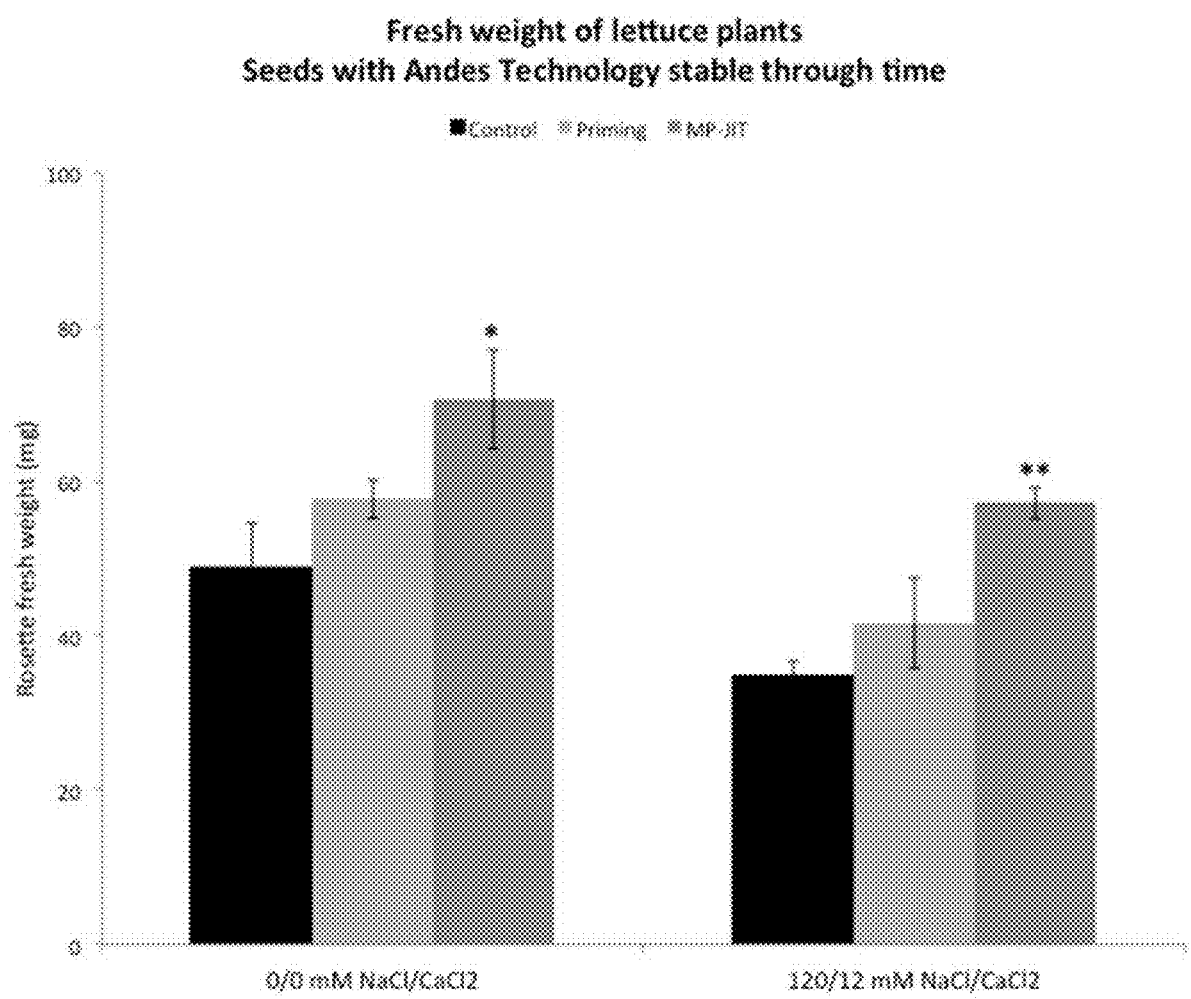
FIG. 14 shows the effect of Microprime™ seed treatment on lettuce seeds (*Lactuca sativa*) growing under salinity stress.

Certain beneficial bacterial treatments on plants may induce abiotic stress tolerance. To evaluate if Microprime™ seed treatment using JIT consortia induce tolerance to abiotic stress, lettuce plants (Harris Moran cv. Desert Storm) were grown 14 days on salt stress condition after which the whole plants fresh weight was measured (FIG. 14). An in-vitro assay was performed using square plates with Murashige and Skoog medium supplemented with 120/12 mM $NaCl/CaCl_2$ (salt stress) and control plates without salt (0/0 mM $NaCl/CaCl_2$). Plants were grown at 19° C., with 54% humidity and a photoperiod of 16 h/8 h (light/dark hours). Bars are means±1 standard error of at least 10 plants per treatment. Asterisks represent statistically significant differences (one-way ANOVA, p-value <0.05; Dunnett's multiple comparisons test, p-value <0.05).

These results show that the Microprime™ treatment with JIT consortium induces salinity tolerance in lettuce plants.

Figure 15:
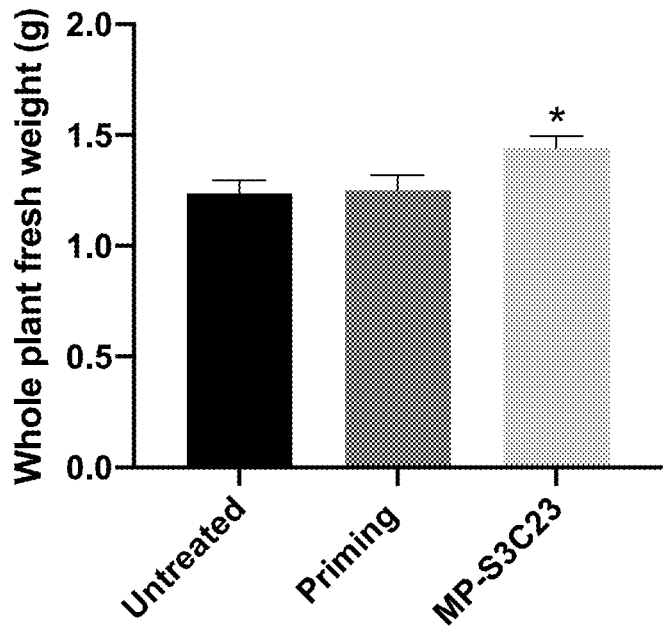
FIG. 15 shows the effect of the Microprime™ seed treatment on tomato (*Solanum lycopersicum*) growth and development.

Example 8. Microprime™ Seed Treatment Effect on Tomato Plants Growth and Development In order to evaluate the effect of Microprime™ seed treatment on tomato plants growth and development, seeds of *Solanum lycopersicum* (Ferry-Morse cv. Roma VF) were treated with a Microprime™ seed treatment including the bacterial isolate, *Bacillus subtilis*, internally denominated strain S3C23. The complete plant fresh weight of Control (untreated), Priming and MP-S3C23 tomato seedlings were measured 42 days after sowing as is shown in FIG. 15. The treatment named Priming is a negative control consisting of the imbibition of the seeds into a solution without the bacteria. Bars are means±1 standard error of at least 15 plants per treatment. Asterisks represent statistically significant differences (one-way ANOVA, p-value <0.05; Dunnett's multiple comparisons test, p-value <0.05). Colony forming-units (CFU) per ml of strain S3C23 in the imbibition medium was of 1.20E+9 CFU/ml. The CFU/seed after drying the seeds was 4.00E+3. The Microprime™ seed treatment conditions were 240 minutes (4 hours) at 30° C. The assay was performed in a greenhouse, peat:perlite soil as substrate, in a growth period of 42 days. The growth temperature was 25° C., with 54% humidity and a photoperiod of 16 hours of light and 8 hours of dark.

These results show that Microprime™ treatment using strain S3C23 significantly increase the fresh weight of tomato plants.

Example 9. Microprime™ Effect in Maize Growth and Development

Figure 16A:
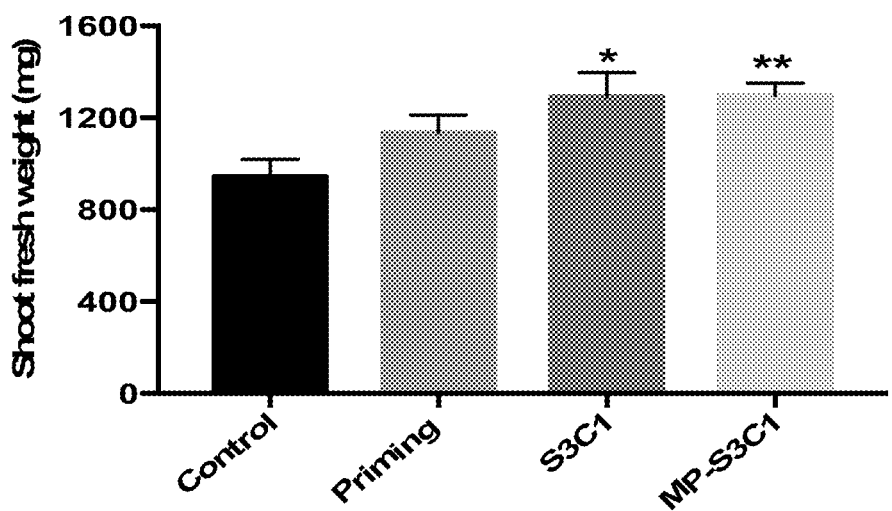
FIG. 16A shows the effect of the Microprime™ seed treatment with a single bacterium (S3C1) on maize (*Zea mays*) growth and development as measured by shoot weight.
Figure 16B:
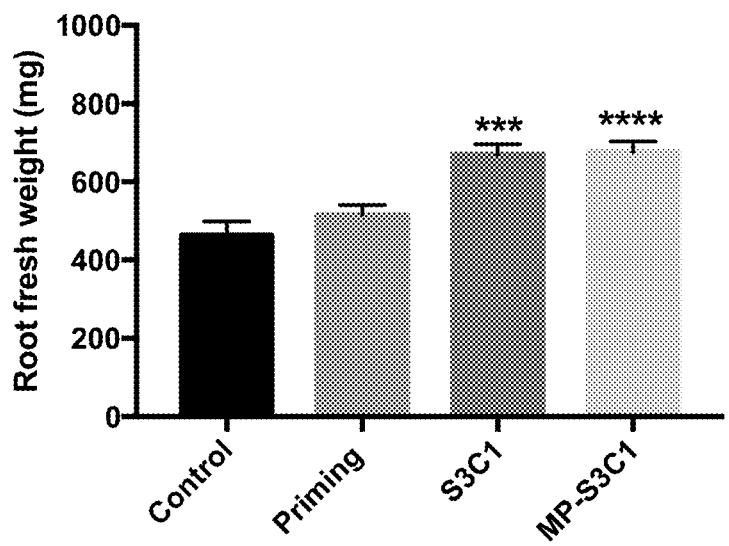
FIG. 16B shows the effect of the Microprime™ seed treatment with a single bacterium (S3C1) on maize (*Zea mays*) growth and development as measured by root weight

In order to evaluate the effect of Microprime™ seed treatment in maize plant growth and development, seeds of *Zea mays* (non-GMO seed from Dekalb brand, DK630) were treated with a Microprime™ seed treatment including a bacterial isolate, *Microbacterium chocolatum*, internally denominated strain S3C1. FIG. 16 shows the fresh weight of the shoot and root of the plants measured 14 days after sowing in a semi solid substrate. The treatments include liquid inoculated seeds (S3C1) and Microprime™ treated seeds (MP-S3C1), Priming treated seeds (Priming) and in non-treated and non-inoculated seeds (Control). The treatment named S3C1 is a positive control corresponding to the external inoculation of seeds with the strain S3C1, as traditional microbial technology application is performed (liquid formulation, outside the seed). The treatment named Priming is a negative control consisting of the imbibition of seeds into a solution without the bacterial consortium. The Colony Forming Units (CFU) per seed of MP-S3C1 seeds was $1.90E+5$ and the Microprime™ seed treatment conditions were 960 minutes (16 hours) at 30° C. Bars are means±1 standard error of at least 15 plants per treatment. Asterisks represent statistically significant differences (Kruskal Wallis, p-value <0.05; Dunn's multiple comparisons test, p-value <0.05). The seed treatments were performed at 30° C., for 5 minutes, after which the seeds were dried until achieving a 11.2% moisture content. Colony Forming Units (CFU) per ml in the Microprime™ seed treatment was $7.79E+15$. The CFU per seed after drying the seeds was $1.9E+5$. The assay was performed in greenhouse and with a semi solid substrate. Data was obtained 14 days after sowing (14 DAS). Growth temperature was 25° C., humidity 54% and the photoperiod 16 hours of light and 8 hours of dark. The shoot fresh weight of maize plants was increased by a 37.2% by effect of the seed treatment MP-S3C1 (FIG. 16A) and the root fresh weight of maize plants was increased by a 45.9% by effect of the seed treatment MP-S3C1 (FIG. 16B).

Figure 17A:
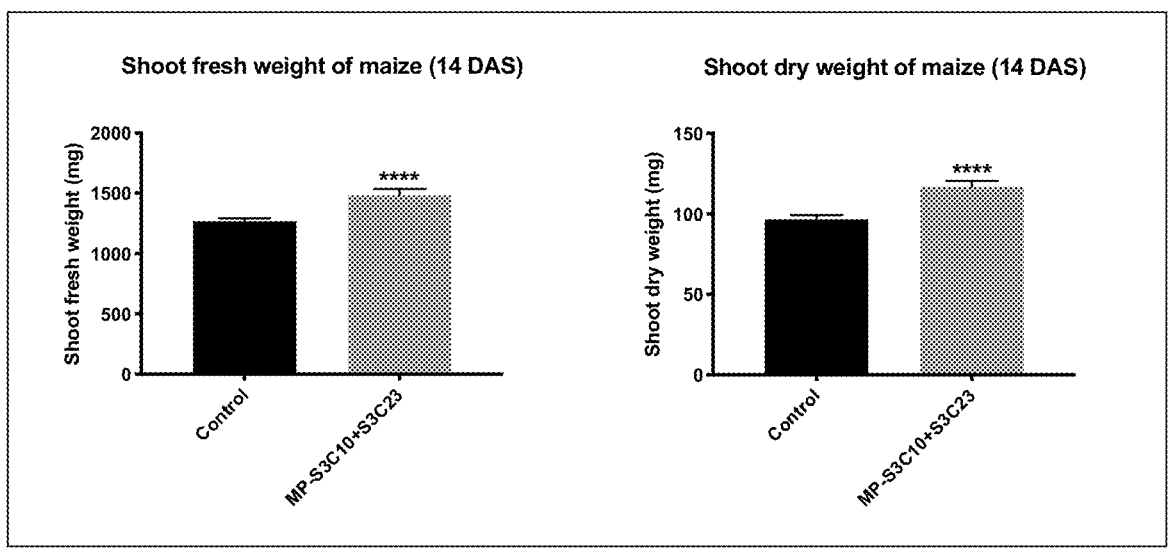
FIG. 17A shows the effect of the Microprime™ seed treatment with a synthetic consortium comprising two bacteria (strains S3C10 and S3C23) on maize (*Zea mays*) growth and development as measured by shoot weight.
Figure 17B:
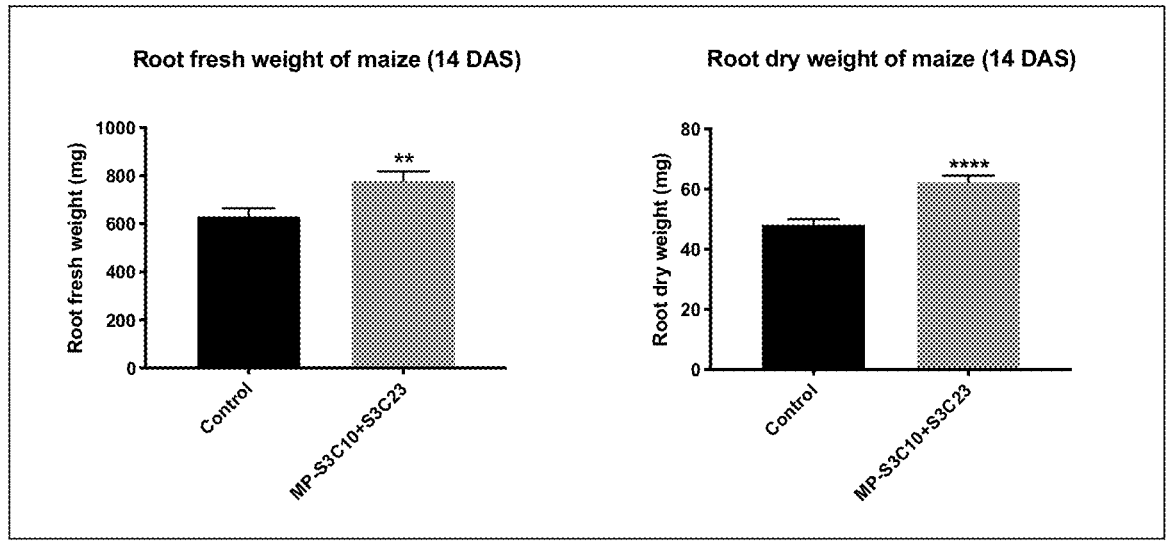
FIG. 17B shows the effect of the Microprime™ seed treatment with a synthetic consortium comprising two bacteria (strains S3C10 and S3C23) on maize (*Zea mays*) growth and development as measured by root weight.
Figure 17C:
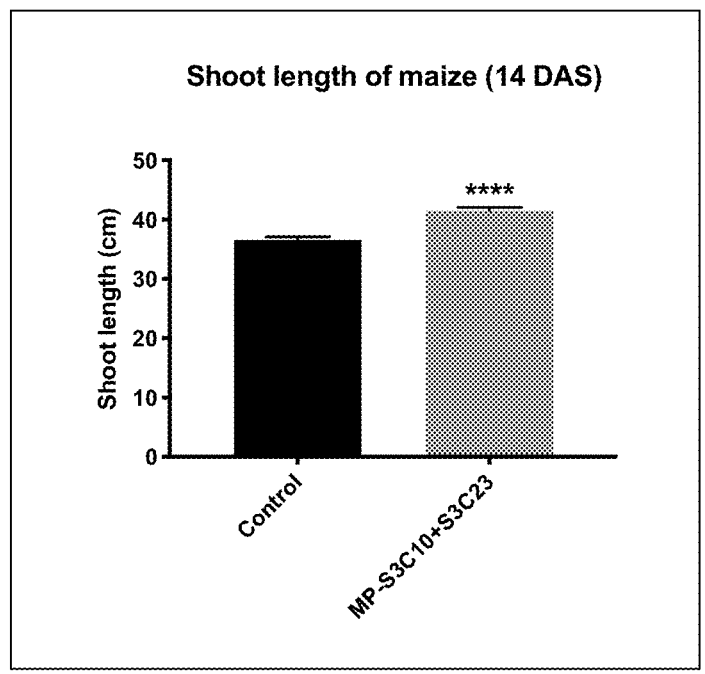
FIG. 17C shows the effect of the Microprime™ seed treatment with a synthetic consortium comprising two bacteria (strains S3C10 and S3C23) on maize (*Zea mays*) growth and development as measured by shoot length.

To evaluate the effect of multiple bacteria, a synthetic consortium comprising two bacterial isolates, *Ensifer adhaerens* (S3C10) and *Bacillus subtilis* (S3C23) was tested (FIG. 17). A non-GMO seed from Dekalb, DK630, was used. The Colony Forming Units (CFU) per ml in the Microprime™ seed treatment solution was $4.52E+10$ for strain S3C10 and $3.76E+08$ for strain S3C23. The seed treatment was performed at a temperature of 30° C., for 10 minutes, after which the seeds were dried until achieving a 11.4% moisture content. The CFU per seed after loading these two strains simultaneously were $2.20E+03$ CFU/seed for strain S3C10 and $5.00E+01$ CFU/seed for strain S3C23. The plant growth assay was performed in a greenhouse, semi solid substrate during a growth period of 14 days after sowing (14 DAS). Growth temperature was 25° C., humidity 54% and the photoperiod 16 hours of light and 8 hours of dark. Bars are means±1 standard error of at least 30 plants per treatment. Asterisks represent statistically significant differences (Mann Whitney test, p-value <0.05). The shoot weight increased 21.0% (FIG. 17A) and the root weight increased 29.3% by effect of the seed treatment MP-S3C10+ S3C23 (FIG. 17B). In addition, the shoot length increased 13.6% by effect of the same consortium (FIG. 17C), indicating that the Microprime™ treatment with lower bacteria concentration in comparison to the ones applied as a liquid form is effective in enhancing the growth of maize seedlings.

Example 10. Microprime™ Effect in Maize Growth Under Nitrogen Deficiency

Figure 18:
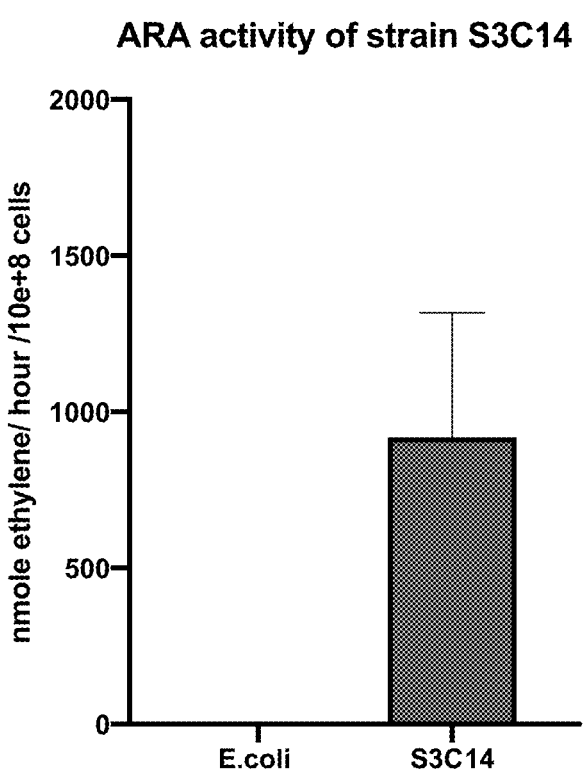
FIG. 18 shows the performance of a fixing-nitrogen bacteria (strain S3C14) under an acetylene reduction assay.
Figure 19:
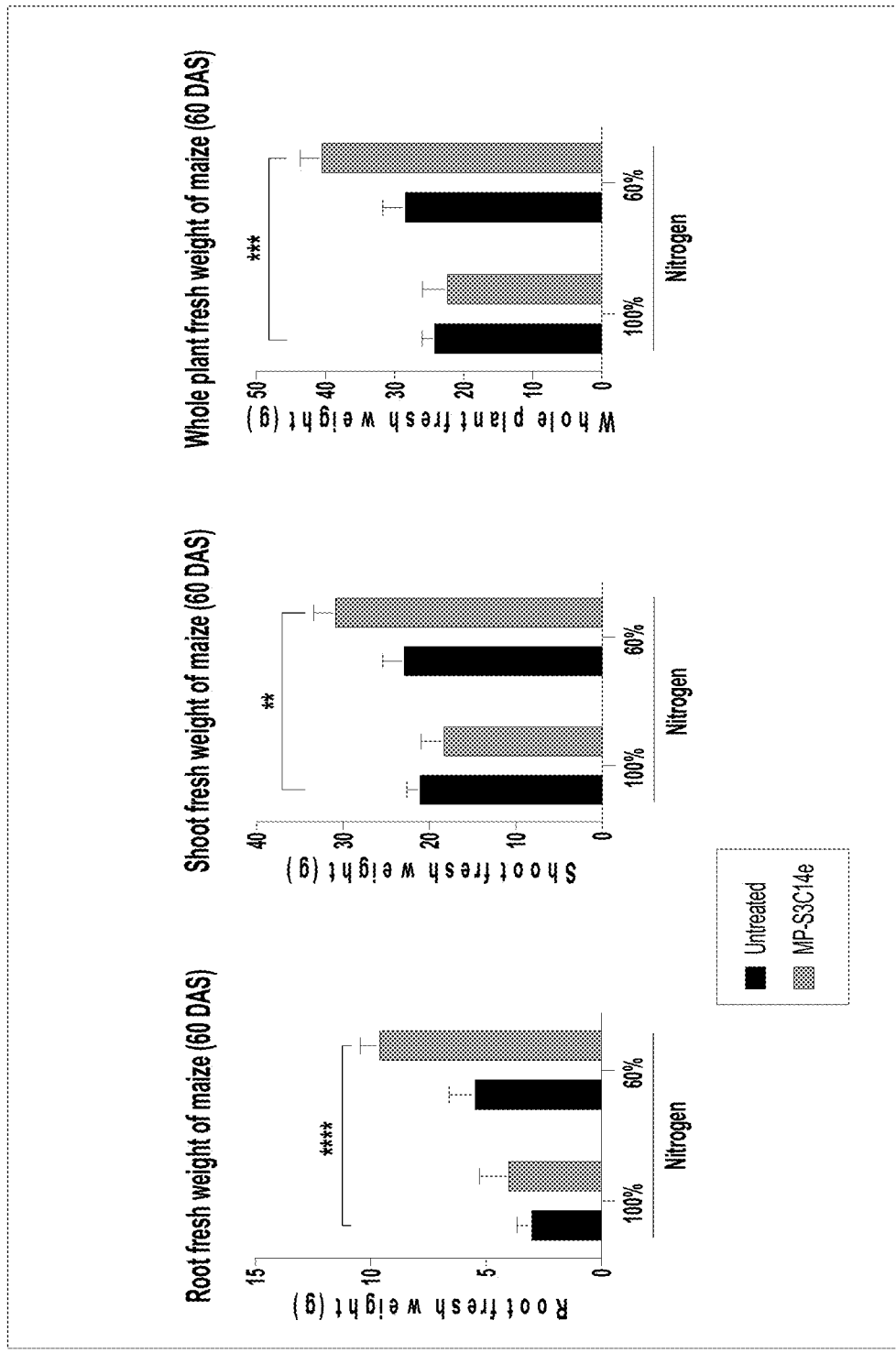
FIG. 19 shows the performance of maize plants (*Zea mays*) from a Microprime™ treated seed with endospores of a fixing-nitrogen bacteria (strain S3C14) under nitrogen deficiency

Promote biological nitrogen fixation in crops has always been desirable due as large amounts of chemical fertilizers used in the agriculture. The ability of using a Microprime™ seed treatment to incorporate diazotrophic bacteria inside the seed and allow the plant to growth in nitrogen deficiency condition was evaluated. Initially, the Acetylene Reduction Assay (ARA) was used to measure nitrogenase activity of pure culture of bacterial isolates. Different isolates were grown in an airtight flask and the reduction of acetylene to ethylene was measure. In this screening, the isolate internally named S3C14 (*Bacillus cucumis*) was identified as a diazotrophic bacterium (FIG. 18). A non-GMO seed from Dekalb (DK630) was used for a Microprime™ seed treatment with endospores of strain S3C14 (MP-S3C14e). The Colony Forming Units per seed was $1.62E+3$ and the Microprime™ seed treatment conditions were 20 min at 23° C. After the seeds were dried up until achieving a 11.6% moisture. A group of Control untreated seeds (untreated) and MP-S3C14e were grown under a regime of 100% and 60% synthetic nitrogen. After 60 days, shoot, root and the total fresh weight of plants were measured, as is shown in FIG. 19. Bars are means±1 standard error of at least 12 plants per treatment. Asterisks represent statistically significant differences (Mann Whitney test, p-value <0.05). The assay was performed in a greenhouse, with peat:perlite soil as substrate. Growth temperature was 25° C., humidity 54% and the photoperiod of 16 hours of light and 8 hours of dark.

The results indicate that plants of Microprime™ treated seeds increase significantly the whole plant fresh weight when grown under nitrogen deficiency, increasing both, the shoot and root weight (FIG. 19).

Figure 20:
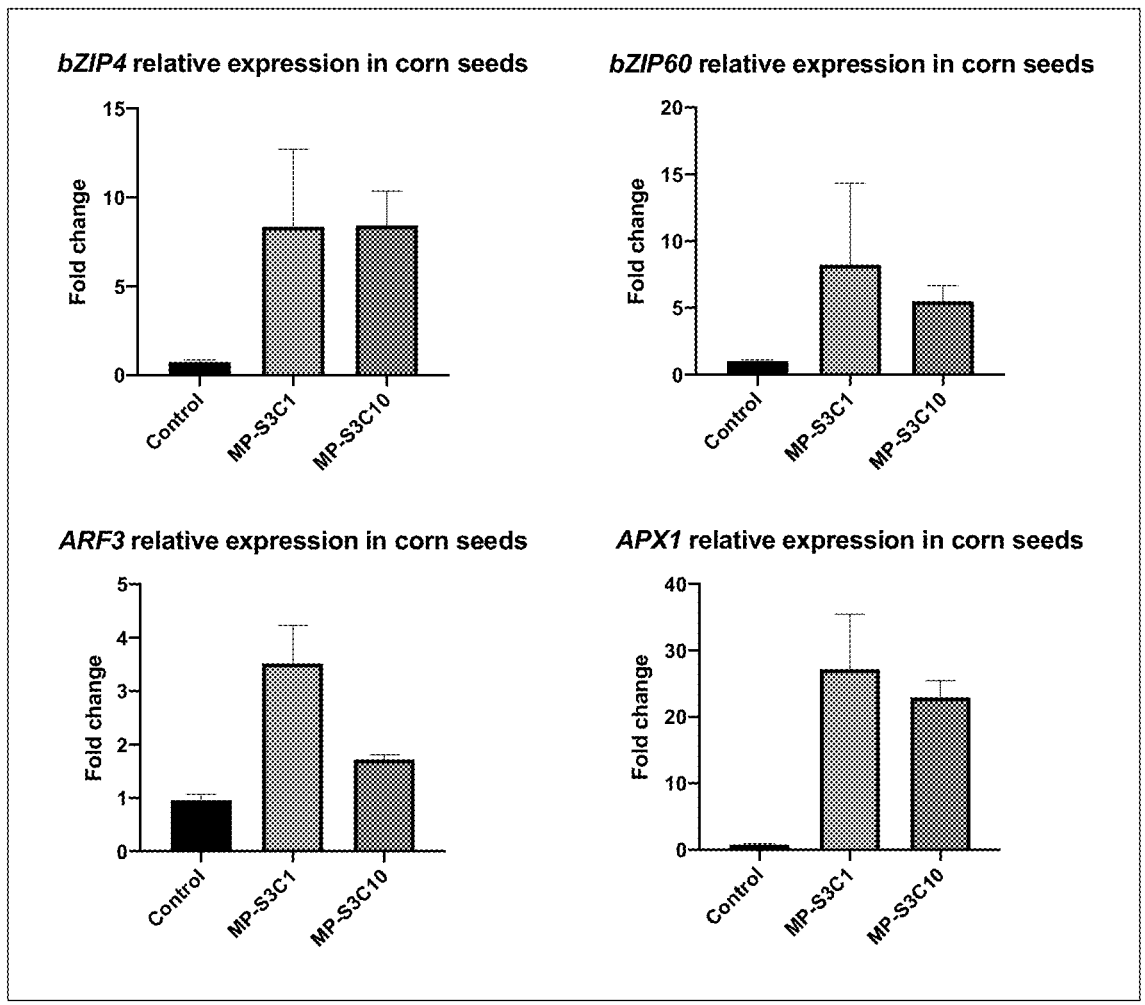
FIG. 20 shows the expression patterns of a group of maize (*Zea mays*) genes in response to Microprime™ seed treatment.

Example 11. Microprime™ Seed Treatment Effect on Maize Growth Under Drought Stress Drought is one of the most harmful forms of abiotic stress for plants and seriously limits the productivity of agricultural crops. Corn is considered a sensitive plant to drought stress. To evaluate if Microprime™ seed treatment with selected bacteria is capable to modulate the plant gene expression and induce an abiotic stress tolerance, a gene expression profile and an in-vivo assay with Microprime™ seeds/plants were performed. The relative expression of the marker genes bZIP60, bZIP4, ARF3 and APX1 was quantified by qRT-PCR in DK630 seeds (Dekalb) four months after Microprime™ treatment with the isolated strain S3C1 (*Microbacterium chocolatum*) and S3C10 (*Ensifer adhaerens*) independently (FIG. 20). The Colony Forming Units (CFU) per seed in MP-S3C10 seeds was $5.00E+4$ and $1.90E+5$ for MP-S3C1 seeds. The Microprime™ seed treatment conditions were 960 minutes (16 hours) at 30° C. Untreated seeds were used as a control. As housekeeping genes for an endogenous control, UBCE and UBCP were used, corresponding to the ubiquitin-conjugating enzyme and the ubiquitin carrier protein respectively (Manoli et al., 2012). These genes were used for data normalization of the cycle threshold (Ct) of qRT-PCR amplifications. Bars are means±standard error of three to five biological replicates per treatment, each replicate consisted of a pool of three corn seeds and two technical replicates. The transcription factor bZIP60 is important in conditioning the response to heat stress. The transcription factor bZIP4 is a positive regulator of plant abiotic stress responses and is involved in root development in maize. Its expression is induced by high salinity, drought, heat and cold and its overexpression resulted in an increased number of lateral roots, longer primary roots and an improved root system. ARF3 is an Auxin-related gene, which in combination with bZIP4 enhance root development. APX1 gene (Ascorbate peroxidase 1) is an oxidative stress gene mainly inducible by heat-stress conditions. Its product is a H2O2-scavenging enzyme.

Overall these results shown molecular priming at the early stage of the plant embryo improving plants ability to respond stronger and faster to an eventual scenario of abiotic stress and, on the other hand, enhances root development and in consequence, its entire performance on field conditions.

Figure 21:
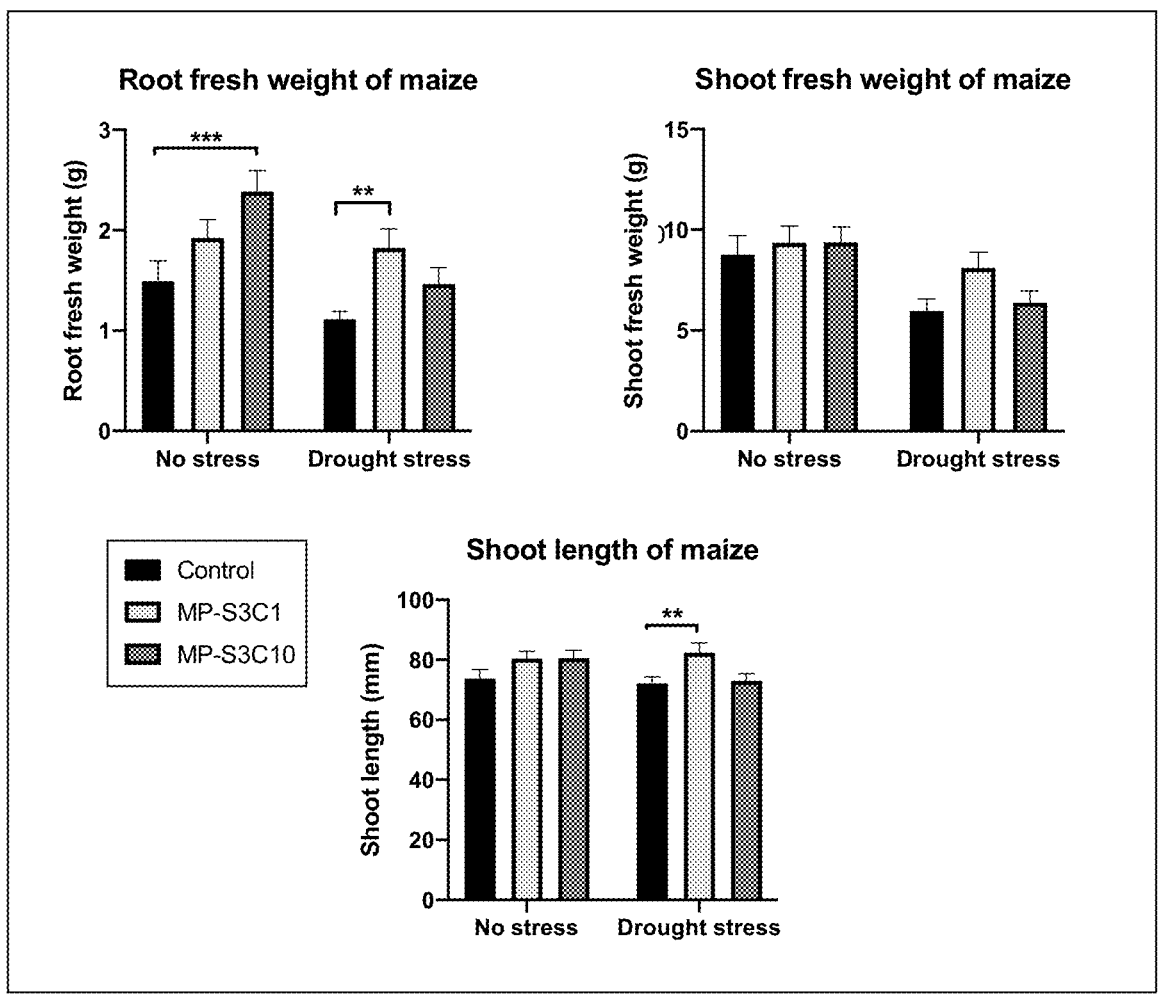
FIG. 21 shows the performance of Microprime™ maize plants (Zea mays) under water stress condition.

To evaluate this assumption, an abiotic stress assay (drought) was performed with maize seeds from the same batch. MP-S3C1, MP-S3C10 and Control seeds were sown in peat:perlite soil as substrate and grown at 25° C., humidity 54% and a photoperiod of 16 hours of light and 8 hours of dark in a greenhouse for 60 days. Seven days after sowing, the group of plants designated for the water restriction was watered for three weeks with 50% of the optimal irrigation regime. After this time, plants underwent a higher water stress treatment by cessation of irrigation for 30 days. Once the 60 days trial was over, MP-S3C1 plants growing under drought conditions showed an increase in root fresh weight and shoot length compared to control plants in the same stress condition, indicating that the molecular priming (likely Induced Systemic Tolerance, or IST) performed at an embryo level mediated by the Microprime™ seed treatment technology, was effectively translated into plants (FIG. 21).

Example 12: Microprime™ Seed Treatment Effect in Maize Growth in Field

In order to evaluate the efficacy of Microprime™ seed treatment on maize (*Zea mays*) growth and yield, a field trial was conducted. The Microprime™ seed treatment was performed using two bacterial isolates, *Microbacterium chocolatum*, internally named S3C1, and *Ensifer adhaerens*, internally named S3C10. The non-GMO DK630 seed from Dekalb was used in this experiment and control plants correspond to non-treated and non-inoculated seeds. The Colony Forming Units per seed in MP-S3C10 seeds was 5.00E+4 CFU/seed and in MP-S3C1 1.90E+5 CFU/seed. The Microprime™ seed treatment conditions were 960 minutes (16 hours) at 30° C.

Figure 22A:
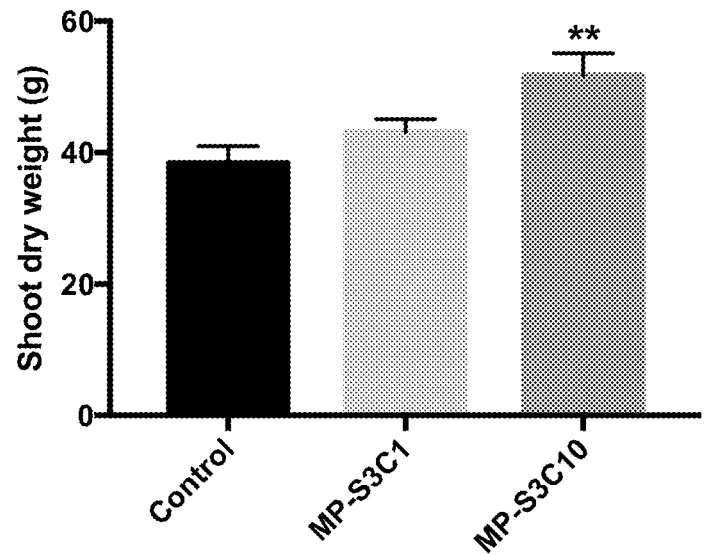
FIG. 22A shows the effect of the vegetative development of Microprime™ maize plants (Zea mays) under field conditions as measured by shoot weight.
Figure 22B:
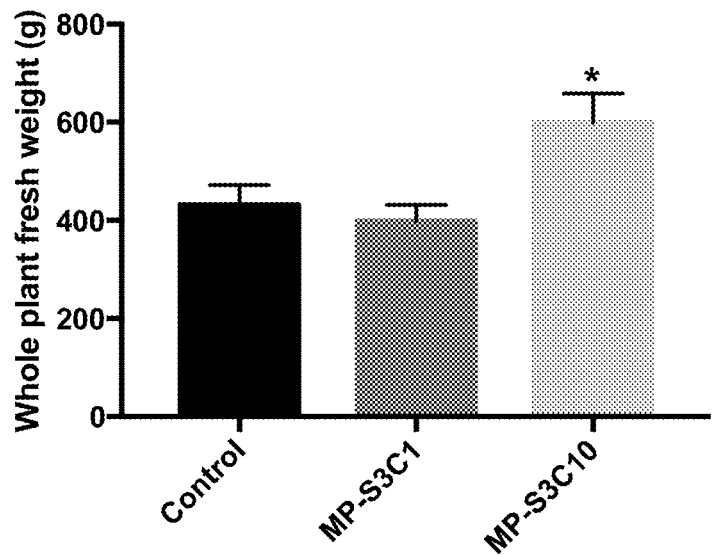
FIG. 22B shows the effect of the vegetative development of Microprime™ maize plants (Zea mays) under field conditions as measured by whole plant weight.

The effect of the Microprime™ seed treatment on whole plant fresh weight and shoot dry weight of maize plants at V12 development stage grown under field conditions was recorded and showed in FIG. 22A and FIG. 22B. The whole plant fresh weight of maize plants was increased by a 35.9% by effect of the Microprime™ seed treatment with strain S3C10 (FIG. 22B) and the shoot dry weight was increased by a 34.9% by effect of the same Microprime™ seed treatment (FIG. 22A). Bars are means±1 standard error of at least 15 plants per treatment. Asterisks represent statistically significant differences (one-way ANOVA, p-value <0.05; Dunnett's multiple comparisons test, p-value <0.05).

Figure 23A:
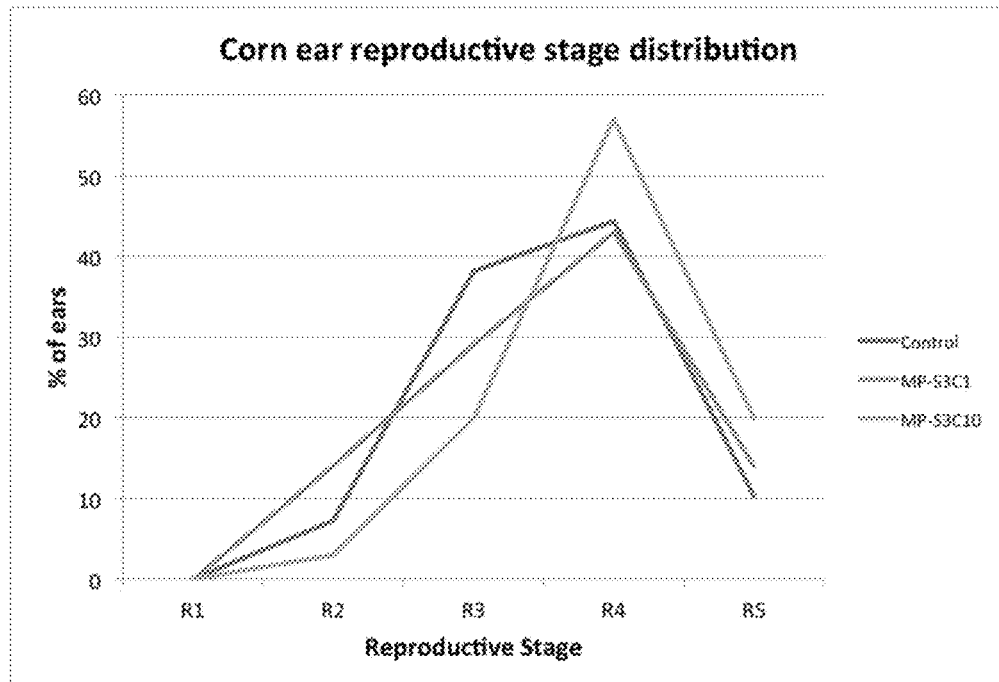
FIG. 23A shows the effect of Microprime™ seed treatment on maize (Zea mays) life cycle under field conditions as a graph showing the percentage of ears in various reproductive stages.
Figure 23B:
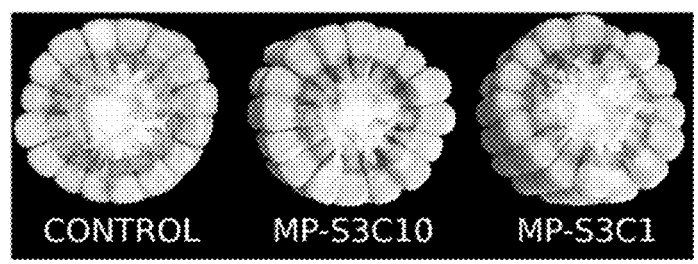
FIG. 23B shows the effect of Microprime™ seed treatment on maize (Zea mays) life cycle under field conditions as shown by images of corncobs

FIG. 23A and FIG. 23B show the effect of the Microprime™ seed treatment on maize life cycle under field conditions. The Microprime™ seed treatment accelerates the growth rate of corn plants evidencing a more advanced vegetative stage (Table 12) and therefore reproductive stage in comparison to control plants. FIG. 23B shows that ears of control plants are in R5 reproductive stage while ears of Microprime™ seed plants (MP-S3C1 and MP-S3C10) are in R6 reproductive stage, the final development stage in maize plants.

Figure 24:
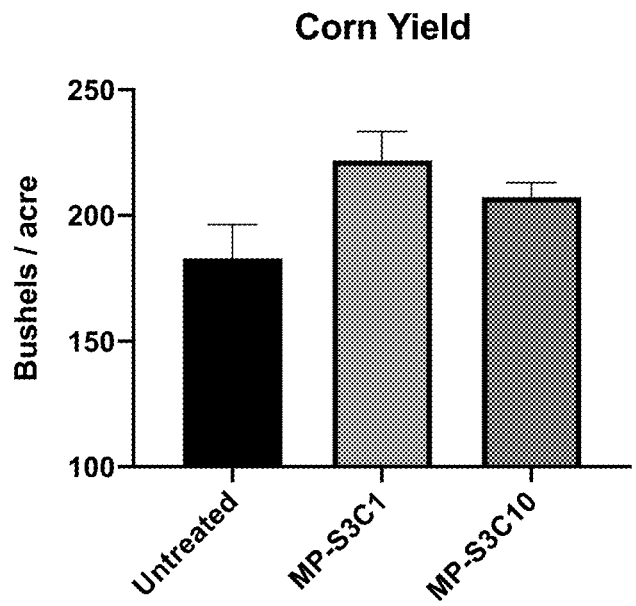
FIG. 24 shows the effect of Microprime™ seed treatment on maize (Zea mays) yield under field conditions.

FIG. 24 shows the effect of the Microprime™ seed treatment on corn yield under field conditions. Yield corresponds to bushels per acre of dry kernels (with a 15.5% moisture content).

Corn yield was increased by a 27.6% (46.5 bu/acre) by effect of the seed treatment MP-S3C1 and by 5.9% (9.9 bu/acre) by effect of the seed treatment MP-S3C10.

Figure 25:
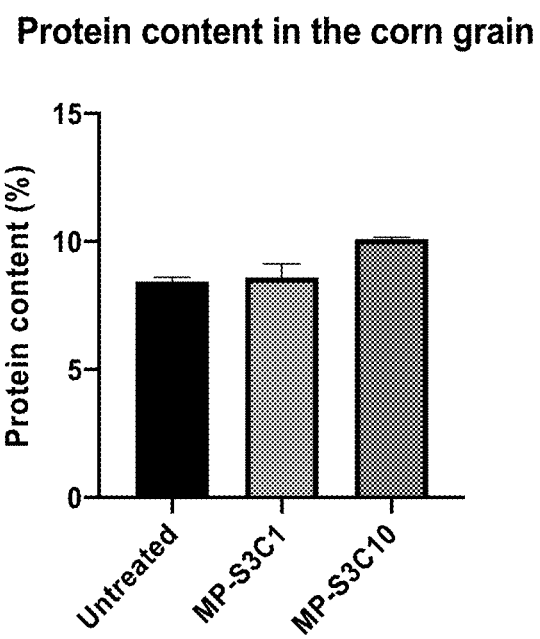
FIG. 25 shows the grain protein content of Microprime™ maize plants (Zea mays) growing in the field.

Also, the total protein content of the grains increased (20%) by effect of the Microprime™ seed treatment with strain S3C10 (FIG. 25).

This important result demonstrated that with a single and unique inoculation of certain beneficial bacteria inside de seed by a Microprime™ seed treatment process, is possible to improve plants traits and yield performance under field conditions.

TABLE 12

| Treatment | Avg. of leaves number | Stage of develonment |
|---|---|---|
| Control | 11.78 | V11-V12 |
| MP-S3C1 | 12.61 | V12-V13 |
| MP-S3C10 | 13.33 | V13 |

Figure 26:
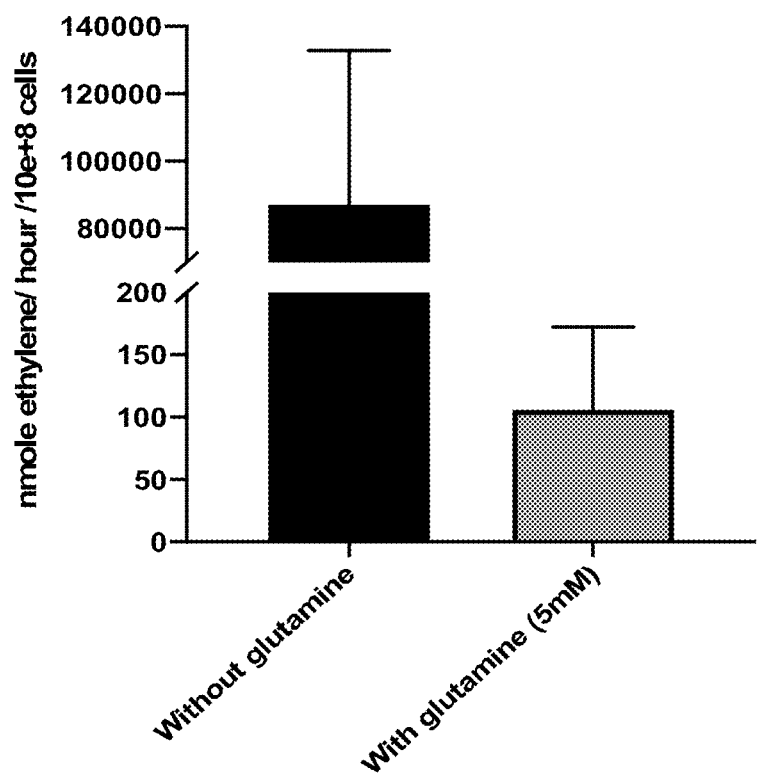
FIG. 26 shows the performance of a fixing-nitrogen bacteria (strain S3C23) under an acetylene reduction assay in presence of nitrogen.

Example 13: Microprime™ Seed Treatment Effect in Maize Growth Under Nitrogen Deficiency in Field In order to evaluate the efficacy of Microprime™ seed treatment on maize growth and yield under nitrogen deficiency, a field trial was conducted. Initially, the Acetylene Reduction Assay (ARA) was used to measure nitrogenase activity of pure culture of bacterial isolates. In this new screening, the bacterial isolate *Bacillus subtilis*, internally denominated strain S3C23 was identified as a diazotrophic bacterium. Due to this finding a new ARA assay was performed to determine if strain S3C23 has the ability to fix nitrogen in presence of an external nitrogen source, e.g. glutamine. For this assay, strain S3C23 was grown in an airtight flask with a medium supplemented or not with glutamine 5 mM for five days. Then acetylene was injected and after two days the reduction of acetylene to ethylene was measure. As is shown in FIG. 26, strain S3C23 continues to fix nitrogen even in the presence of glutamine. Due this result, strain S3C23 was selected for a corn field trial with nitrogen restriction.

Figure 27:
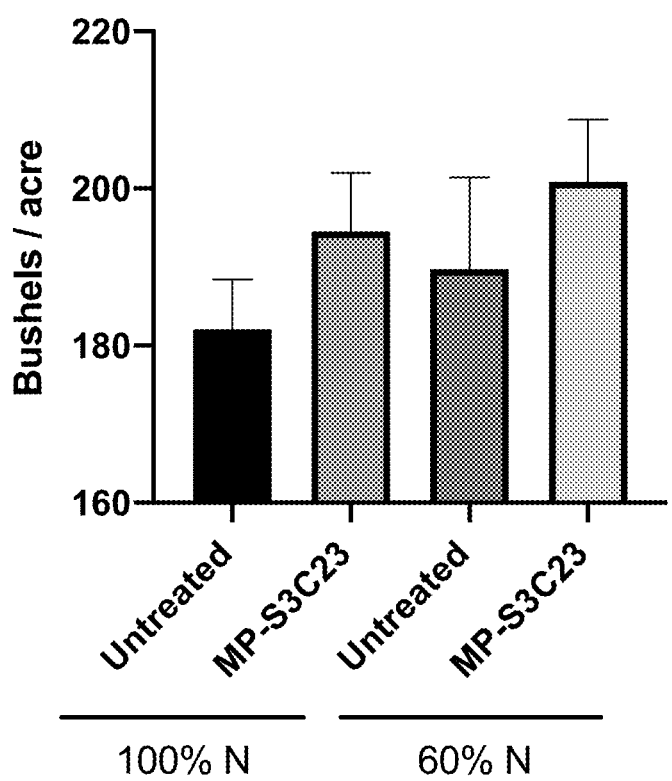
FIG. 27 shows the effect of Microprime™ seed treatment on maize (Zea mays) yield under nitrogen deficiency in field.

FIG. 27 shows the effect of the Microprime™ seed treatment on maize yield under nitrogen restriction. The GMO seed DKC47-27RIB from Dekalb™, was used. 100% nitrogen (100% N) corresponds to 150 lbs/acre of synthetic nitrogen and 60% nitrogen (60% N) corresponds to 90 lbs/acre of synthetic nitrogen. Yield corresponds to bushels per acre of dry kernels (15.5% moisture content). The Microprime™ seed treatment was performed using the bacterial isolate *Bacillus subtilis*, internally denominated strain S3C23. Control plants correspond to non-treated and non-inoculated seeds. The Colony Forming Units (CFU) per seed in MP-S3C23 seeds was 4.98E+3 CFU/seed and the Microprime™ seed treatment conditions were 20 minutes at 30° C.

Under 40% of nitrogen restriction corn yield was increased by a 10.3% (18.8 bu/acre) compared to plants grown in 100% nitrogen by effect of the Microprime™ seed treatment MP-S3C23. On the other hand, under normal growing conditions with 100% nitrogen, corn yield increased by 6.9% (12.5 bu/acre) by effect of the Microprime™ seed treatment MP-S3C23.

Figure 28:
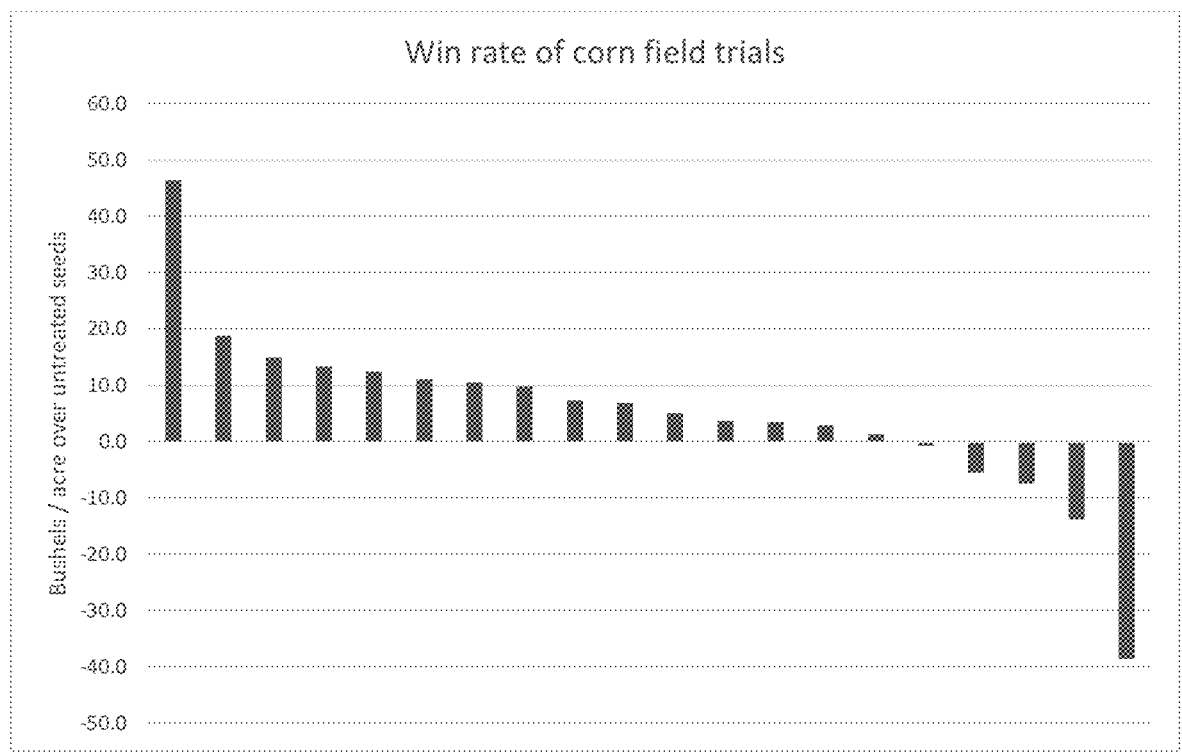
FIG. 28 shows a win rate exercise that summarized maize (Zea mays) field trial data performed with the Microprime™ seed treatment technology.

The win rate of the corn field trials performed was 75% (FIG. 28).

Microprime™ seed treatment is a stable microbial and embryo seed treatment methodology by which is incorporated a plant-beneficial bacterium and/or a synthetic consortium of microorganisms and/or its exudates and/or its individualized biomolecules inside of seeds through an industrially scalable process. This seed treatment process is compatible with the traditional distribution chain for agricultural inputs.

Given the results obtained with Microprime™ seeds in the field trials, an economic model for Andes Microprime™ corn seeds was made based on an economic model from the Iowa State University which includes all involved costs for corn production after a soybean growth season (https://www.extension.iastate.edu/agdm/crops/html/al-20.html). The assumptions to build our economic model were the following:

1. Microprime™ corn seeds have the same price to farmers as a regular corn seed (without Microprime™ treatment).
2. The liquid formulation corresponds to the same bacterium or bacterial consortium used for the Microprime™ seeds.
3. The liquid formulation has an additional cost for the farmer of $20.00 per acre.

The economic model of Andes Microprime™ corn seeds is summarized in the following table (Table 13).

TABLE 13

| | |
|---|---|
| Andes Microprime ™ extra yield (typical observed scenario): | 9 bu/acre |
| Andes synthetic nitrogen reduction rate: | 40% total |
| Expected yield: | 191.1 bu/acre |
| Farm size: | 500 acres |

| | Microprime ™ | Liquid formulation |
|---|---|---|
| Andes Total Net Return | $76,330 | $66,330 |
| Typical Total Net Return | $49,637 | $49,637 |
| | | |
| Total extra benefit | $26,693 | $16,693 |
| Andes Net Return per acre | $152.66 | $132.66 |
| Typical Net Return per acre | $ 99.27 | $ 99.27 |
| Extra benefit per acre | $ 53.39 | 33.39 |

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

REFERENCES

Ali, S. Z., Sandhya, V., Grover, M., Kishore, N., Rao, L. V., and Venkateswarlu, B. (2009). *Pseudomonas* sp. strain AKM-P6 enhances tolerance of sorghum seedlings to elevated temperatures. Biol. Fertil. Soils. doi:10.1007/s00374-009-0404-9.

Ashraf, M., and Foolad, M. R. (2005). Pre-Sowing Seed Treatment-A Shotgun Approach to Improve Germination, Plant Growth, and Crop Yield Under Saline and Non-Saline Conditions. Adv. Agron. 88, 223-271. doi:10.1016/50065-2113(05)88006-X.

Badri, D. V., Chaparro, J. M., Zhang, R., Shen, Q., and Vivanco, J. M. (2013). Application of natural blends of phytochemicals derived from the root exudates of *arabidopsis* to the soil reveal that phenolic-related compounds predominantly modulate the soil microbiome. J. Biol. Chem. doi:10.1074/jbc.M112.433300.

Badri, D. V., and Vivanco, J. M. (2009). Regulation and function of root exudates. Plant, Cell Environ. doi: 10.1111/j.1365-3040.2009.01926.x.

Baez-Rogelio, A., Morales-Garcia, Y. E., Quintero-Hernández, V., and Muñoz-Rojas, J. (2017). Next generation of microbial inoculants for agriculture and bioremediation. Microb. Biotechnol. 10, 19-21. doi:10.1111/1751-7915.12448.

Bais, H. P., Weir, T. L., Perry, L. G., Gilroy, S., and Vivanco, J. M. (2006). THE ROLE OF ROOT EXUDATES IN RHIZOSPHERE INTERACTIONS WITH PLANTS AND OTHER ORGANISMS. Annu. Rev. Plant Biol. doi:10.1146/annurev.arplant.57.032905.105159.

Barea, J. M. (2015). Future challenges and perspectives for applying microbial biotechnology in sustainable agriculture based on a better understanding of plant-microbiome interactions. J. soil Sci. plant Nutr. 15, 0-0. doi:10.4067/S0718-95162015005000021.

Barea, J. M., Azcón, R., and Azcón-Aguilar, C. (2002). Mycorrhizosphere interactions to improve plant fitness and soil quality. Antonie van Leeuwenhoek, Int. J. Gen. Mol. Microbiol. doi:10.1023/A:1020588701325.

Bashan, Y. (1998). Inoculants of plant growth-promoting bacteria for use in agriculture. Biotechnol. Adv. doi: 10.1016/S0734-9750(98)00003-2.

Bashan, Y., de-Bashan, L. E., Prabhu, S. R., and Hernandez, J. P. (2014). Advances in plant growth-promoting bacterial inoculant technology: Formulations and practical perspectives (1998-2013). Plant Soil 378, 1-33. doi:10.1007/s11104-013-1956-x.

Bennett, A. J., Mead, A., and Whipps, J. M. (2009). Performance of carrot and onion seed primed with beneficial microorganisms in glasshouse and field trials. Biol. Control 51, 417-426. doi:10.1016/j.biocontrol.2009.08.001.

Bennett, A. J., and Whipps, J. M. (2008a). Beneficial microorganism survival on seed, roots and in rhizosphere soil following application to seed during drum priming. Biol. Control. doi:10.1016/j.biocontrol.2007.11.005.

Bennett, A. J., and Whipps, J. M. (2008b). Dual application of beneficial microorganisms to seed during drum priming. Appl. Soil Ecol. doi:10.1016/j.apsoil.2007.08.001.

Berninger, T., González López, Ó., Bejarano, A., Preininger, C., and Sessitsch, A. (2018). Maintenance and assessment of cell viability in formulation of non-sporulating bacterial inoculants. Microb. Biotechnol. 11, 277-301. doi:10.1111/1751-7915.12880.

Calabi-Floody, M., Medina, J., Rumpel, C., Condron, L. M., Hernandez, M., Dumont, M., et al. (2018). Smart Fertilizers as a Strategy for Sustainable Agriculture. Adv. Agron. 147, 1-59. doi:10.1016/bs.agron.2017.10.003.

Callan, N. W., Mathre, D. E., and Miller, J. B. (1990). Bio-priming Seed Treatment for Biological Control of *Pythium ultimum* Preemergence Damping-off in sh2 Sweet Corn. Plant Dis. doi:10.1094/PD-74-0368.

Callan, N. W., Mathre, D. E., and Miller, J. B. (1991). Field performance of sweet corn seed bio-primed and coated with *Pseudomonas fluorescens* AB254. Hortscience.

Cassán, F., and Diaz-Zorita, M. (2016). *Azospirillum* sp. in current agriculture: From the laboratory to the field. Soil Biol. Biochem. doi:10.1007/978-3-319-76132-9_10.

Chakraborty, U., Roy, S., Chakraborty, A. P., Dey, P., and Chakraborty, B. (2011). Plant Growth Promotion and Amelioration of Salinity Stress in Crop Plants by a Salt-Tolerant Bacterium. Recent Res. Sci. Technol.

Chamam, A., Sanguin, H., Bellvert, F., Meiffren, G., Comte, G., Wisniewski-Dye, F., et al. (2013). Plant secondary metabolite profiling evidences strain-dependent effect in the *Azospirillum-Oryza sativa* association. Phytochemistry. doi:10.1016/j.phytochem.2012.11.009.

Chaparro, J. M., Badri, D. V., Bakker, M. G., Sugiyama, A., Manter, D. K., and Vivanco, J. M. (2013). Root Exudation of Phytochemicals in *Arabidopsis* Follows Specific Patterns That Are Developmentally Programmed and Correlate with Soil Microbial Functions. PLoS One. doi:10.1371/journal.pone.0055731.

Date, R. A. (2001). Advances in inoculant technology: A brief review. Aust. J. Exp. Agric. doi:10.1071/EA00006.

de Freitas, J., and Germida, J. (1992). GROWTH PROMOTION OF WINTER WHEAT BY FLUORESCENT PSEUDOMONADS UNDER FIELD CONDITIONS. 24.

Deaker, R., Kecskes, M., and Michael Timothy Rose, Khanok-on Amprayn, GRosalind Deaker, Mihaly kecskes, Michael Timothy Rose, Khanok-on Amprayn, Ganisan Krishnen, Tran Thi Kim Cuc, Vu Thuy Nga, Phan Thi Cong, Nguyen Thanh Hien and Ivan Robert Kennedya, N. T. H. and I. R. K. (2011). Practical methods for the quality control of inoculant biofertilisers. Aust. Cent. Int. Agric. Res.

Dimkpa, C., Weinand, T., and Asch, F. (2009). Plant-rhizobacteria interactions alleviate abiotic stress conditions. Plant, Cell Environ. doi:10.1111/j.1365-3040.2009.02028.x.

Dunham Trimmer (2017). URL http://wrir4.ucdavis.edu/events/2017_SLR_Meeting/Presentations/GeneralPresentations/1%20Trimmer %20-%20Global %20Biocontrol %20Market %202017.pdf).

El-Mougy, N. S., and Abdel-Kader, M. M. (2008). Long-term activity of bio-priming seed treatment for biological control of *faba* bean root rot pathogens. Australas. Plant Pathol. 37, 464-471. doi:10.1071/AP08043.

Fasciglione, G., Casanovas, E. M., Quillehauquy, V., Yommi, A. K., Goñi, M. G., Roura, S. I., et al. (2015). *Azospirillum* inoculation effects on growth, product quality and storage life of lettuce plants grown under salt stress. Sci. Hortic. (Amsterdam). doi:10.1016/j.scienta.2015.09.015.

GAP 2017 Global Agricultural Productivity Report: A World of Productive Sustainable Agriculture. Available at: http://www.globalharvestinitiative.org.

HEYDECKER, W., HIGGINS, J., and GULLIVER, R. L. (1973). Accelerated Germination by Osmotic Seed Treatment. Nature 246, 42. Available at: http://dx.doi.org/10.1038/246042a0.

Hill, H. J., Cunningham, J. D., Bradford, K. J., & Taylor, A. G. (2007). Primed lettuce seeds exhibit increased sensitivity to moisture content during controlled deterioration. HortScience, 42(6), 1436-1439. doi.org/10.21273/HORTSCI.42.6.1436.

IRP (2017). Assessing global resource use: A systems approach to resource efficiency and pollution reduction. Bringezu, S., Ramaswami, A., Schandl, H., O'Brien, M., Pelton, R., Acquatella, J., Ayuk, E., Chiu, A., Flanegin, R., Fry, J., Giljum, S., Hashimoto, S., Hellweg, S., Hosking, K., Hu, Y., Lenzen, M., Lieber, M., Lutter, S., Miatto, A., Singh Nagpure, A., Obersteiner, M., van Oers, L., Pfister, S., Pichler, P., Russell, A., Spini, L., Tanikawa, H., van der Voet, E., Weisz, H., West, J., Wiijkman, A., Zhu, B., Zivy, R. A Report of the International Resource Panel. United Nations Environment Programme. Nairobi, Kenya.

Kaur, J., Gangwar, M., and Pandove, G. (2018). Mitigating the impact of climate change by use of microbial inoculants. ~279~Pharma Innov. J.

Kloepper, J. W., Ryu, C.-M., and Zhang, S. (2004). Induced Systemic Resistance and Promotion of Plant Growth by *Bacillus* spp. Phytopathology 94, 1259-1266. doi:10.1094/PHYTO.2004.94.11.1259.

Kumar, A. (2016). PHOSPHATE SOLUBILIZING BACTERIA IN AGRICULTURE BIOTECHNOLOGY: DIVERSITY, MECHANISM AND THEIR ROLE IN PLANT GROWTH AND CROP YIELD. Arvind. Int. J. Adv. Res. doi:10.21474/IJAR01.

Ledger, T., Rojas, S., Timmermann, T., Pinedo, I., Poupin, M. J., Garrido, T., et al. (2016). Volatile-mediated effects predominate in *Paraburkholderia phytofirmans* growth promotion and salt stress tolerance of *Arabidopsis thaliana*. Front. Microbiol. doi:10.3389/fmicb.2016.01838.

Ledger, T., Zúñiga, A., Kraiser, T., Dasencich, P., Donoso, R., Pérez-Pantoja, D., et al. (2012). Aromatic compounds degradation plays a role in colonization of *Arabidopsis thaliana* and Acacia caven by *Cupriavidus pinatubonensis* JMP134. Antonie van Leeuwenhoek, Int. J. Gen. Mol. Microbiol. doi:10.1007/s10482-011-9685-8.

Leggett, M., Diaz-Zorita, M., Koivunen, M., Bowman, R., Pesek, R., Stevenson, C., et al. (2017). Soybean response to inoculation with *Bradyrhizobium japonicum* in the United States and Argentina. Agron. J. doi:10.2134/agronj2016.04.0214.

Leggett, M., Newlands, N. K., Greenshields, D., West, L., Inman, S., and Koivunen, M. E. (2015). Maize yield response to a phosphorus-solubilizing microbial inoculant in field trials. J. Agric. Sci. 153, 1464-1478. doi:10.1017/S0021859614001166.

Lugtenberg, B., and Kamilova, F. (2009). Plant-growth-promoting Rhizobacteria. Annu. Rev. Microbiol. doi:10.1146/annurev.micro.62.081307.162918.

Mahakham, W., Sarmah, A. K., Maensiri, S., and Theerakulpisut, P. (2017). Nanopriming technology for enhancing germination and starch metabolism of aged rice seeds using phytosynthesized silver nanoparticles. Sci. Rep. 7, 8263. doi:10.1038/s41598-017-08669-5.

Mahmood, A., Turgay, O. C., Farooq, M., and Hayat, R. (2016). Seed biopriming with plant growth promoting rhizobacteria: A review. FEMS Microbiol. Ecol. 92, 1-14. doi:10.1093/femsec/fiw112.

Manoli A, Sturaro A, Trevisan S, Quaggiotti S, Nonis A. (2012). Evaluation of candidate reference genes for qPCR in maize. J Plant Physiol. 2012. doi:10.1016/j.jplph.2012.01.019.

Marulanda, A., Azcón, R., Chaumont, F., Ruiz-Lozano, J. M., and Aroca, R. (2010). Regulation of plasma membrane aquaporins by inoculation with a Bacillus megaterium strain in maize (Zea mays L.) plants under unstressed and salt-stressed conditions. Planta. doi:10.1007/s00425-010-1196-8.

McDonald, M. B. (1999). Seed deterioration: Physiology, repair and assessment. Seed Sci. Technol.

McQuilken M. P., Halmer P., Rhodes D. J., 1998. Application of microorganisms to seeds. In: Burges, H. D. (Ed), Formulation of Microbial Biopesticides: Beneficial microorganisms, nematodes and seed treatments. Kluwer Academic Publishers, Dordrecht, pp 255-285.

Meena, K. K., Sorry, A. M., Bitla, U. M., Choudhary, K., Gupta, P., Pareek, A., et al. (2017). Abiotic Stress Responses and Microbe-Mediated Mitigation in Plants: The Omics Strategies. Front. Plant Sci. 8, 1-25. doi: 10.3389/fpls.2017.00172.

Mirshekari, B., Hokmalipour, S., Sharifi, R. S., Farahvash, F., and Ebadi-Khazine-Gadim, A. (2012). Effect of seed biopriming with plant growth promoting rhizobacteria (PGPR) on yield and dry matter accumulation of spring barley (Hordeum vulgare L.) at various levels of nitrogen and phosphorus fertilizers. J. Food, Agric. Environ.

Moeinzadeh, A., Sharif-Zadeh, F., Ahmadzadeh, M., and Tajabadi, F. H. (2010). Biopriming of sunflower (Helianthus annuus L.) seed with Pseudomonas fluorescens for improvement of seed invigoration and seedling growth. Aust. J. Crop Sci.

Molina-Romero, D., Baez, A., Quintero-Hernández, V., Castañeda-Lucio, M., Fuentes-Ramirez, L. E., Bustillos-Cristales, M. del R., et al. (2017). Compatible bacterial mixture, tolerant to desiccation, improves maize plant growth. PLoS One. doi:10.1371/journal.pone.0187913.

Müller, H., and Berg, G. (2008). Impact of formulation procedures on the effect of the biocontrol agent Serratia plymuthica HRO-C48 on Verticillium wilt in oilseed rape. BioControl. doi:10.1007/s10526-007-9111-3.

Murunde, R., and Wainwright, H. (2018). BIO-PRIMING TO IMPROVE THE SEED GERMINATION, EMERGENCE AND SEEDLING GROWTH OF KALE, CARROT AND ONIONS Ruth Murunde and Henry Wainwright The Real IPM limited Company, P.O. Box 4001-01002 Madaraka, Thika, Kenya. Glob. J. Agric. Res. 6, 26-34.

Ngumbi, E., and Kloepper, J. (2016). Bacterial-mediated drought tolerance: Current and future prospects. Appl. Soil Ecol. 105, 109-125. doi:10.1016/j.apsoil.2016.04.009.

Niu, B., & Kolter, R. (2018). Quantification of the Composition Dynamics of a Maize Root-associated Simplified Bacterial Community and Evaluation of Its Biological Control Effect. Bio-protocol, 8(12). doi: 10.21769/BioProtoc.2885.

O'Callaghan, M. (2016). Microbial inoculation of seed for improved crop performance: issues and opportunities. Appl. Microbiol. Biotechnol. 100, 5729-5746. doi: 10.1007/s00253-016-7590-9.

Pinedo, I., Ledger, T., Greve, M., and Poupin, M. J. (2015). Burkholderia phytofirmans PsJN induces long-term metabolic and transcriptional changes involved in Arabidopsis thaliana salt tolerance. Front. Plant Sci. doi:10.3389/fpls.2015.00466.

Pozo, M. J., Jung, S. C., López-Ráez, J. A., and Azcón-Aguilar, C. (2010). "Impact of arbuscular mycorrhizal symbiosis on plant response to biotic stress: The role of plant defence mechanisms," in Arbuscular Mycorrhizas: Physiology and Function doi:10.1007/978-90-481-9489-6_9.

Raj, S. N., Shetty, N. P., and Shetty, H. S. (2004). Seed bio-priming with Pseudomonas fluorescens isolates enhances growth of pearl millet plants and induces resistance against downy mildew. Int. J. Pest Manag. 50, 41-48. doi:10.1080/09670870310001626365.

Reddy, P. P. (2013). Recent advances in crop protection. doi:10.1007/978-81-322-0723-8.

Rosenblueth, M., and Martinez-Romero, E. (2006). Bacterial Endophytes and Their Interactions with Hosts. Mol. Plant-Microbe Interact. doi:10.1094/MPMI-19-0827.

Ryan, R. P., Germaine, K., Franks, A., Ryan, D. J., and Dowling, D. N. (2008). Bacterial endophytes: Recent developments and applications. FEMS Microbiol. Lett. doi:10.1111/j.1574-6968.2007.00918.x.

Santoro, M. V., Cappellari, L. R., Giordano, W., and Banchio, E. (2015). Plant growth-promoting effects of native Pseudomonas strains on Mentha piperita (peppermint): An in vitro study. Plant Biol. doi:10.1111/plb.12351.

Savka, M. A., Dessaux, Y., Oger, P., and Rossbach, S. (2002). Engineering Bacterial Competitiveness and Persistence in the Phytosphere. Society. doi:10.1094/MPMI.2002.15.9.866.

Sasse, J., Martinoia, E., & Northen, T. (2018). Feed your friends: do plant exudates shape the root microbiome?. Trends in plant science. doi:10.1016/j.tplants.2017.09.003.

Sessitsch, A., Brader, G., Pfaffenbichler, N., Gusenbauer, D., and Mitter, B. (2018). The contribution of plant microbiota to economy growth. Microb. Biotechnol. doi: 10.1111/1751-7915.13290.

Shahzad, S. M., Khalid, A., Arif, M. S., Riaz, M., Ashraf, M., Iqbal, Z., et al. (2014). Co-inoculation integrated with P-enriched compost improved nodulation and growth of Chickpea (Cicer arietinum L.) under irrigated and rainfed farming systems. Biol. Fertil. Soils. doi:10.1007/s00374-013-0826-2.

Sharifi, R. S. (2011). Grain yield and physiological growth indices in maize (Zea mays L.) hybrids under seed biopriming with plant growth promoting rhizobacteria (PGPR). J. Food, Agric. Environ. doi:10.1002/oby.20937.

Sharifi, R. S., Khavazi, K., and Gholipouri, A. (2011). Effect of seed priming with plant growth promoting Rhizobacteria (PGPR) on dry matter accumulation and yield of maize (Zea mays L.) hybrids. Int. Res. J. Biochem. Bioinform. doi:http://dx.doi.org/10.1016/j.lithos.2012.11.008.

Song, G. C., Choi, H. K., Kim, Y. S., Choi, J. S., and Ryu, C. M. (2017). Seed defense biopriming with bacterial cyclodipeptides triggers immunity in cucumber and pepper. Sci. Rep. 7, 1-15. doi:10.1038/s41598-017-14155-9.

Sturz, A. V., Christie, B. R., and Nowak, J. (2000). Bacterial endophytes: Potential role in developing sustainable systems of crop production. CRC. Crit. Rev. Plant Sci. doi:10.1080/07352680091139169.

Sundaramoorthy, S., Raguchander, T., Ragupathi, N., and Samiyappan, R. (2012). Combinatorial effect of endophytic and plant growth promoting rhizobacteria against wilt disease of *Capsicum annum* L. caused by *Fusarium solani*. Biol. Control. doi:10.1016/j.biocontrol.2011.10.002.

Schwember, A. R., & Bradford, K. J. (2011). Oxygen interacts with priming, moisture content and temperature to affect the longevity of lettuce and onion seeds. Seed Science Research, 21(3), 175-185. doi:10.1017/ 50960258511000080.

Tabassum, T., Ahmad, R., Farooq, M., and Ahmed Basra, S. M. (2018). Improving salt tolerance in barley by osmopriming and biopriming. Int. J. Agric. Biol. doi: 10.17957/IJAB/15.0788.

Tarquis, A. M., & Bradford, K. J. (1992). Prehydration and priming treatments that advance germination also increase the rate of deterioration of lettuce seeds. Journal of Experimental Botany, 43(3), 307-317. doi.org/10.1093/ jxb/43.3.307.

Taylor, A. G., Allen, P. S., Bennett, M. A., Bradford, K. J., Burris, J. S., and Misra, M. K. (1998). Seed enhancements. Acta Hortic. 607, 53-59. doi:10.17660/ActaHortic.2003.607.8.

Taylor, A., and Harman, G. (1990). Concepts and technologies of selected seed treatments.

Timmermann, T., Armijo, G., Donoso, R., Seguel, A., Holuigue, L., & González, B. (2017). *Paraburkholderia phytofirmans* PsJN protects *Arabidopsis thaliana* against a virulent strain of *Pseudomonas syringae* through the activation of induced resistance. Molecular Plant-Microbe Interactions. doi: 10.1094/MPMI-09-16-0192-R Timmusk, S., Behers, L., Muthoni, J., Muraya, A., and Aronsson, A.-C. (2017). Perspectives and Challenges of Microbial Application for Crop Improvement. Front. Plant Sci. 8, 1-10. doi:10.3389/fpls.2017.00049.

Vacheron, J., Desbrosses, G., Bouffaud, M.-L., Touraine, B., Moënne-Loccoz, Y., Muller, D., et al. (2013). Plant growth-promoting rhizobacteria and root system functioning. Front. Plant Sci. doi:10.3389/fpls.2013.00356.

Vacheron, J., Moënne-Loccoz, Y., Dubost, A., Gonçalves-Martins, M., Muller, D., and Prigent-Combaret, C. (2016). Fluorescent *Pseudomonas* Strains with only Few Plant-Beneficial Properties Are Favored in the Maize Rhizosphere. Front. Plant Sci. doi:10.3389/fpls.2016.01212.

Vaikuntapu, P. R., Dutta, S., Samudrala, R. B., Rao, V. R. V. N., Kalam, S., and Podile, A. R. (2014). Preferential Promotion of *Lycopersicon esculentum* (Tomato) Growth by Plant Growth Promoting Bacteria Associated with Tomato. Indian J. Microbiol. doi:10.1007/s12088-014-0470-z.

Van Loon, L. C. (2007). "Plant responses to plant growth-promoting rhizobacteria," in New Perspectives and Approaches in Plant Growth-Promoting Rhizobacteria Research doi:10.1007/978-1-4020-6776-1_2.

Vejan, P., Abdullah, R., Khadiran, T., Ismail, S., and Nasrulhaq Boyce, A. (2016). Role of plant growth promoting rhizobacteria in agricultural sustainability-A review. Molecules 21. doi:10.3390/molecules21050573.

Wang, W., He, A., Peng, S., Huang, J., Cui, K., & Nie, L. (2018). The effect of storage condition and duration on the deterioration of primed rice seeds. Frontiers in Plant Science, 9, 172. doi.org/10.3389/fpls.2018.00172.

Wright, B., Rowse, H. R., and Whipps, J. M. (2003). Application of beneficial microorganisms to seeds during drum priming. Biocontrol Sci. Technol. doi:10.1080/ 09583150310001517992.

Yadav, R. S., Singh, V., Pal, S., Meena, S. K., Meena, V. S., Sarma, B. K., et al. (2018). Seed bio-priming of baby corn emerged as a viable strategy for reducing mineral fertilizer use and increasing productivity. Sci. Hortic. (Amsterdam). 241, 93-99. doi:10.1016/j.scienta.2018.06.096.

Yang, J., Kloepper, J. W., and Ryu, C. M. (2009). Rhizosphere bacteria help plants tolerate abiotic stress. Trends Plant Sci. doi:10.1016/j.tplants.2008.10.004.

Zoppellari, F., Malusà, E., Chitarra, W., Lovisolo, C., Spanna, F., and Bardi, L. (2014). Improvement of drought tolerance in maize (*Zea mays* L.) by selected rhizospheric microorganisms. Ital. J. Agrometeorol.

Zulfikar Ali, S., Sandhya, V., Grover, M., Linga, V. R., and Bandi, V. (2011). Effect of inoculation with a thermotolerant plant growth promoting *Pseudomonas putida* strain AKMP7 on growth of wheat (*Triticum* spp.) under heat stress. J. Plant Interact. doi:10.1080/ 17429145.2010.545147.

US Patent 2016/0330976 A1, Indigo Ag, "Method for propagating microorganisms within plant bioreactors and stably storing microorganisms within agricultural seeds". Mitter et al, 2016b US Patent 2016/0338360 A1, Indigo Ag, "Plants containing beneficial endophytes". Mitter et al, 2106 a PCT/US2016/017204
US2016/0338360A1
US2016/0330976A1
US2017/0223967A1
US2018/0020677A1
US2010/0154299A1
US2015/0289515 A1
US2018/0064116A1
US2018/098483A1
US2018/0064116A1
US2018/0132486A1

SEQUENCE LISTING (10221 sequences)

SEQ ID NO: 1 - DNA, 1560 bp, Acetonema longum
  ref <308>: DATABASE ACCESSION NUMBER: NCBI ACCESSION: NZ_AFGF01000106.1
  ref <309>: DATABASE ENTRY DATE: 2019-04-01
  ref <313>: RELEVANT RESIDUES IN SEQ ID NO: (1)..(1560)
tggagagtttgatcctggctcaggacgaacgctggcggcgtgcttaacacatgcaagtcgaacggggagttagcaataactccaagtggcgaacgggtgagtaacgcgtagacaatctgcccttgagatggggacaacgttccgaaaggagcgctaataccgaatgttgtggagaggatgcatatcttctttactaaaggtggcctctatatataagctaccactcaaggaggggtctgcgtctgattagctagttggtgaggtaacggctcaccaaggcgacgatcagtagccggtctgagaggatgaacggccacactgggactgagacacggcccagactcctacgggaggcagcagtggggaatcttccgcaatgggcgaaagcctgacggagcaacgccgcgtgagtgaagaaggttttcggattgtaaagctctgtctttcgggacgaatgtgcgggtggtaaataatcactcgtaatgacggtaccgaaggaggaagccacggctaactacgtgccagcagccgcggtaatacgtaggtggcaagcgttgtccggaatgattgggcgtaaagcgcgcgcaggcgggtttataagtctgttgtgaaaatgcggggctcaaccccgtagggtcaatggaaactgtaaatcttgagtgcaggagaggaaagcggaattcccagtgtagcggtgaaatgcgtagatattgggaggaacaccagtggcgaaggcggctttctggactgttactgacgctgaggcgcgaaagccagggtagtgaacgggattagataccccggtaatcctggccgtaaacgatgggtactaggtgtaggaggtatcgacccctcctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccagggcttgacatcgcctgaagatcctagagatagggagttcccttcggggacaggtagacaggtggtgcatggctgtcgtcagctcgtgtcgtgagatgttgggttaagtcccgcaacgagcgcaacccttattctttgttgccagcacgtaaaggtgggcactcagaggagactgccgcagacaatgcggaggaaggcggggatgacgtcaagtcatcatgccccttatgtcctgggctacacacgtactacaatgggctctaacagagggaagcaaagccgcgaggccaagccaatcccaaaaacgagctctcagttcggatcggaggctgcaactcgcctccgtgaagtcggaatcgctagtaatcgcagatcagcatgctgcggtgaatacgttcccgggccttgtacacaccgcccgtcacaccacgaaagttggaaatacccgaagccggtggggtaactcgcaagagagccagccgtcgaaggtagggccgatgattggggtgaagtcgtaacaaggtagccgtatcggaaggtgcggctggatcacctcctttctatggaga

SEQ ID NO: 2 - DNA, 1545 bp, Actinomyces bovis
  ref <308>: DATABASE ACCESSION NUMBER: NCBI ACCESSION: NZ_UAPQ01000003.1
  ref <309>: DATABASE ENTRY DATE: 2019-04-01
  ref <313>: RELEVANT RESIDUES IN SEQ ID NO: (1)..(1545)
ttttggagagtttgatcctggctcaggacgaacgctggcggcgtgcttaacacatgcaagtcgaacggtgaagcccagcttgctgggtggatgagtggcgaacgggtgagtaacacgtgagtaacctgcccctgacttctggataaccgcttgaaagggtggctaatacgggatattttggcctgctcgcatgggtgggtttggaaaggttctttttctggttggggatgggctcgcggcctatcagcttgttggtggggtgatggcctaccaaggctttgacgggtagccggcctgagagggtggacggccacactgggactgagacacggcccagactcctacgggaggcagcagtggggaatattgcacaatgggcgcaagcctgatgcagcgacgccgcgtgagggatgtaggccttcgggttgtgaacctctttcgccagtgaagcaggccgccttctttgtggggtggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactggaggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtgggggctctttccggggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgggtgttgatcacggagacgtggtttctcttcggagcgccttcacaggtggtgcatggttgtcgtcagctcgtgtcgtgagatgttgggttaagtcccgcaacgagcgcaacccttgtcccgtgttgccagcacgttgtggtggggactcgcgggagactgccggggttaactcggaggaaggtggggatgacgtcaaatcatcatgccccttatgtcttgggcttcacgcatgctacaatggctggtacagagggttgcgatgtcgtgaggcggagcgaatcccttaaagccagtctcagttcggatcggtgtctgcaactcgacaccgtgaagttggagtcgctagtaatcgcagatcagcaacgctgcggtgaatacgttctcgggccttgtacacaccgcccgtcacgtcatgaaagctggcaacacccgaagcccgtggccttatggggagcggtcgaaggtggggctggtgattgggacgaagtcgtaacaaggtagccgtaccggaaggtgcggctggatcacctcctttctaaggagca

SEQ ID NO: 3 - DNA, 1548 bp, Actinomyces bowdenii
  ref <308>: DATABASE ACCESSION NUMBER: NCBI ACCESSION: NZ_RQZC01000038.1
  ref <309>: DATABASE ENTRY DATE: 2019-04-01
  ref <313>: RELEVANT RESIDUES IN SEQ ID NO: (1)..(1548)
tgtttggagagtttgatcctggctcaggacgaacgctggcggcgtgcttaacacatgcaagtcgaacggtgaagcccttttttgggtggatgagtggcgaacgggtgagtaacacgtgagtaacctgcccccttcttctggataacctcatgaaagtggggctaatacgggatattctggtctggtcgcatggctgggctgggaaagatgcgccttttgggtgtttttggtgggggatgggctcgcggcctatcagcttgttggtggggtgatggcctaccaaggcggtgacgggtagccggcctgagagggtggacggccacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgctcctgtgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggggccttttccgggttcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgagggcgatcgcctcggagacggggcttcctttttggcgctcttacaggtggtgcatggttgtcgtcagctcgtgtcgtgagatgttgggttaagtcccgcaacgagcgcaacccttgtcctgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgatgctgtgaggcggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagctggcaacacccgaagcccgtggccctatggggagcggtcgaaggtggggctggtgattgggacgaagtcgtaacaaggtagccgtaccggaaggtgcggctggatcacctcctttcta

SEQ ID NO: 4 - DNA, 1549 bp, Actinomyces canis
  ref <308>: DATABASE ACCESSION NUMBER: NCBI ACCESSION: NZ_RQZF01000020.1
  ref <309>: DATABASE ENTRY DATE: 2019-04-01
  ref <313>: RELEVANT RESIDUES IN SEQ ID NO: (1)..(1549)
tttgttcggagagtttgatcctggctcaggacgaacgctggcggcgtgcttaacacatgcaagtcgaacggaccgcttgggcgctttgcgtttgggttggttagtggcgaacgggtgagtaacacgtgagtaacctgcccccttcttcgggataacgttcggaaacggatgctaataccgggtatttacctcatgtcgcatggtgtggggtggaaaggttttttctggtgggggatgggctcgcggcctatcagcttgttggtggggtgatggcctaccaaggctttgacgggtaaccggcctgagagggtgaccggtcacattgggactgagatacggcccagactcctacgggaggcagcagtggggaattttgcacaatgggcgaaagcctgatgcagcgacgccgcgtgagggatgacggccttcgggttgtaaacctctttcgctcatggtcaaggctagtttttgttctagttgagggtagtgggtaaagaagcgccggctaactacgtgccagcagccgcggtaatacgtagggcgcgagcgttgtccggaattattgggcgtaaagggcttgtaggcggcttgtcgcgtctgccgtgaaaacccacagcttaactgtgggcttgcggtgggtacgggctggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccgcccttggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgacactgcagagatgtggtggccttcggggtggtgtgcaggtggtgcatggttgtcgtcagctcgtgtcgtgagatgttgggttaagtcccgcaacgagcgcaacccttgccctatgttgccagcacgttatggtggggactcgtgggggactgccggggttaactcggaggaaggtggggatgacgtcaaatcatcatgccccttatgtcttgggcttcacgcatgctacaatggctggtacagagggttgcgatgctgtgaggcggagcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgtttggggggagtggtcgaaggtgggattggcgattgggacgaagtcgtaacaaggtagccgtaccggaaggtgcggctggatcacctcctttctagggag

SEQ ID NO: 5 - DNA, 1554 bp, Actinomyces culturomici
  ref <308>: DATABASE ACCESSION NUMBER: NCBI ACCESSION: NZ_LS991316.1
  ref <309>: DATABASE ENTRY DATE: 2019-04-01
  ref <313>: RELEVANT RESIDUES IN SEQ ID NO: (1)..(1554)
tttgttcggagagtttgatcctggctcaggacgaacgctggcggcgtgcttaacacatgcaagtcgaacggactggcttggggtttcggccttgggttggtgagtggcgaacgggtgagtaacacgtgagtaacctgccctcttcttcgggataacggtcggaaacggctgctaatactggatattcacttttgggcgcatgcttgggggtggaaagagttttttggtgggggatgggctcgcggcctatcagcttgttggtggggtgatggcctaccaaggctttgacgggtagccggcctgagagggtgaccggtcacattgggactgagatacggcccagactcctacgggaggcagcagtggggaattttgcacaatgggcgaaagcctgatgcagcgacgccgcgtgagggatggaggccttcgggttgtgaacctctttcgctcatggtcaagccgcaacgtgggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggttgacttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacccagagccctcagagatgggggtgcatttggttgggggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggctggtacagagggttgcgatgctgtgaggcggagcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagctcatggcctaaccgttttggcggggggagtggtcgaaggtgggattggcgattgggacgaagtcgtaacaaggtagccgtaccggaaggtgcggctggatcacctcctttctagggag

SEQ ID NO: 6 - DNA, 1555 bp, Actinomyces denticolens
  ref <308>: DATABASE ACCESSION NUMBER: NCBI ACCESSION: NZ_UFSA01000002.1
  ref <309>: DATABASE ENTRY DATE: 2019-04-01
  ref <313>: RELEVANT RESIDUES IN SEQ ID NO: (1)..(1555)
tgtttggagagtttgatcctggctcaggacgaacgctggcggcgtgcttaacacatgcaagtcgaacggtgatgccctggcttttgttggggtggatgagtggcgaacgggtgagtaacacgtgagtaacctgcccccttcttctggataccgccacgaaagtggtgttaatacgggatattctggctctgtcgcatggtggggttgggaaaggtcttttgtctggtgggggatgggctcgcggcctatcagcttgttggtggggtgatggcctaccaaggcgttgacgggtagccggcctgagagggtggacggccacactgggactgagacacggcccagactcctacgggaggcagcagtggggaatattgcacaatgggcggaagcctgatgcagcgacgccgcgtgagggatggaggccttcgggttgtgaacctctttcgccagtgaagcaggcccgctccttttggtgggcgggttgacggtagctggataagaagcgccggctaactacgtgccagcagccgcggtaatacgtagggcgcgagcgttgtccggaattattgggcgtaaagggcttgtaggcggctggtcgcgtctgccgtgaaatccttcggcttaaccgggggcttgcggtgggtacgggccggcttgagtgcggtaggggaggctggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtggggggcctttccgggttgtccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggatggtctcggagacggggcttcctcattttttggggtcggttcacaggtggtgcatggttgtcgtcagctcgtgtcgtgagatgttgggttaagtcccgcaacgagcgcaacccctgtcccgtgttgccagcgcgttgtggcggggactcgcgggagactgccggggtcaactcggaggagggtggggatgacgtcaaatcatcatgccccttatgtcttgggcttcacgcatgctacaatggccggtacagagggttgcgatgccgtgaggcggggcgaatcccttaaagccggtctcagttcggatcggtgtctgcaactcgacaccgtgaagttggagtcgctagtaatcgcggatcagcaacgccgcggtgaatacgttctcgggccttgtacacaccgcccgtcacgtcatgaaagtcggcaacacccgaagcccgtggccttacggggagcggtcgaaggtggggccggtgattgggacgaagtcgtaacaaggtagccgtaccggaaggtgcggctggatcacctcctttctaaggag

SEQ ID NO: 7 - DNA, 1546 bp, Actinomyces gaoshouyii
  ref <308>: DATABASE ACCESSION NUMBER: NCBI ACCESSION: NZ_CP020468.1
  ref <309>: DATABASE ENTRY DATE: 2019-04-01
  ref <313>: RELEVANT RESIDUES IN SEQ ID NO: (1)..(1546)
tggagagtttgatcctggctcaggacgaacgctggcggcgtgcttaacacatgcaagtcgaacggtgaagccctggcttttgttggggtggatgagtggcgaacgggtgagtaacacgtgagtaacctgcccccttcttctggataccgccacgaaagtggtgttaatacgggatattctggctctgtcgcatggtggggttgggaaaggtcttttgtctggtgggggatgggctcgcggcctatcagcttgttggtggggtgatggcctaccaaggctttgacgggtagccggcctgagagggtggacggccacactgggactgagacacggcccagactcctacgggaggcagcagtgggggatattgcacaatgggcggaagcctgatgcagcgacgccgcgtgagggatggaggccttcgggttgtgaacctctttcgctagtgaagaaggcctgcttttttgggtgggttgacggtagctggataagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccatgctgtaaacgttgggcactaggtgtggggggcctttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtcggtgttggtcgcggagacgtggcttccctgcttttgtggggcgccgtcacaggtggtgcatggttgtcgtcagctcgtgtcgtgagatgttgggttaagtcccgcaacgagcgcaacccctgtcccgtgttgccagcgcgttatggcggggactcgcgggagactgccggggtcaactcggaggagggtggggatgacgtcaaatcatcatgccccttatgtcttgggcttcacgcatgctacaatggccggtacagagggttgcgatgccgtgaggcggggcgaatcccttaaagccggtctcagttcggatcggtgtctgcaactcgacaccgtgaagttggagtcgctagtaatcgcggatcagcaacgccgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaaggtgcggctggatcacctcctttctaagg

SEQ ID NO: 8 - DNA, 1549 bp, Actinomyces georgiae
  ref <308>: DATABASE ACCESSION NUMBER: NCBI ACCESSION: NZ_RSCF01000205.1
  ref <309>: DATABASE ENTRY DATE: 2019-04-01
  ref <313>: RELEVANT RESIDUES IN SEQ ID NO: (1)..(1549)
tttgttcggagagtttgatcctggctcaggacgaacgctggcggcgtgcttaacacatgcaagtcgaacgctgaagcccggctttgtgttgggtggatgagtggcgaacgggtgagtaacacgtgagtaacctgcccccttcttcgggataacggtctgaaagggctgctaataccgggtattcactggtcctcgcatgggggttggtggaaaggttttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtgaacctctttcgcccgtggtcaagccgcgactttggttgtggtgagggtagtgggtaaagaagcgccggctaactacgtgccagcagccgcggtaatacgtagggcgcgagcgttgtccggaattattgggcgtaaagggcttgtaggcggctggtcgcgtctgccgtgaaatcctctggctcaactgggggcgtgcggtgggtacgggctggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccccgggcgcgcggagacgcgcgcgcatttggttgggggtgtgcaggtggtgcatggttgtcgtcagctcgtgtcgtgagatgttgggttaagtcccgcaacgagcgcaacccttgccctatgttgccagcgcgttatggcggggactcgtgggggactgccggggttaactcggaggaaggtggggatgacgtcaaatcatcatgccccttatgtcttgggcttcacgcatgctacaatggctggtacagagggttgcgatgccgtgaggcggggcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacgcccgaagcccatggcccaaccggctcttgctggggggagtggtcgaaggtgggattggcgattgggacgaagtcgtaacaaggtagccgtaccggaaggtgcggctggatcacctcctttcta

SEQ ID NO: 9 - DNA, 1545 bp, Actinomyces graevenitzii
  ref <308>: DATABASE ACCESSION NUMBER: NCBI ACCESSION: NZ_PNHV01000006.1
  ref <309>: DATABASE ENTRY DATE: 2019-04-01
  ref <313>: RELEVANT RESIDUES IN SEQ ID NO: (1)..(1545)
tttttggagagtttgatcctggctcaggacgaacgctggcggcgtgcttaacacatgcaagtcgaacgaaaataccaagcttgcttggttgattagtggcgaacgggtgagtaacacgtgagtaacctgccccttactttctggataactgctcgaaagggtagctaatacgggatattctggccttcctgcatgggttggtttggaaaggttgttttttctggtgagggatgggctcgcggcctatcagcttgttggtggggtgatggcctaccaaggctttgacgggtagccggcctgagagggtggacggtcacactgggactgagatacggcccagactcctacgggaggcagcagtggggaatattgcacaatgggcgcaagcctgatgcagcgacgccgcgtgagggatgaaggccttcgggttgtaaacctctttcgtcagggaacaaggcactgcttttggtggtgttgagggtacctggataagaagcgccggctaactacgtgccagcagccgcggtaatacgtagggcgcaagcgttgtccggaattattgggcgtaaagagctcgtaggcggctggtcgcgtctgtcgtgaaaacttccggctcaaccgggggcttgcggtgggtacgggccggctagagtgcggtaggggtaactggaactcctggtgtagcggtggaatgcgcagatatcaggaagaacaccgatggcgaaggcaggttactgggccgttactgacgctgaggagcgaaagcgtggggagcgaacaggattagataccctggtagtccacgctgtaaacgttgggcactaggtgtgaggctcctttccgggggttttgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttaactgtggctctagagatagggtttacccttttgggtggttttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggctggtacagagggttgcgatactgtgaggtggagctaatcccttaaagctggtctcagttcggattggtgtctgcaactcgacaccatgaaggtggagtcgctagtaatcgcagatcagcaacgctgcggtgaatacgttctcgggccttgtacacaccgcccgtcacgtcacgaaagttggcaacaccccaagaccgtggctctacggggagcggttaaaggtggggctagcgattgggacgaagtcgtaacaaggtagccgtaccggaaggtgcggctggatcacctcctttctaaggag

SEQ ID NO: 10 - DNA, 1562 bp, Actinomyces hominis
  ref <308>: DATABASE ACCESSION NUMBER: NCBI ACCESSION: NZ_PNHU01000001.1
  ref <309>: DATABASE ENTRY DATE: 2019-04-01
  ref <313>: RELEVANT RESIDUES IN SEQ ID NO: (1)..(1562)
tgtttggagagtttgatcctggctcaggacgaacgctggcggcgtgctttacacatgcaagtcgaacgggatccatcttgattctttttgtttcttggtggtgagagtggcgaacgggtgagtaacacgtgagtaacctgcccttttcttttggataaccgcatgaaagtgtggctaatacgggatattctgcttccttcgcatgggggtggtgggaaaggcttcaatgtttttgttgttgtggattgggatgggctcgcggcttatcagcttgttggtggggtgatggcttaccaaggctttgacgggtagccggcctgagagggtgggcggtcacattgggactgagatacggcccagactcctacgggaggcagcagtgggggattttgcacaatggacgcaagtctgatgcagtgacgccgcgtgagggatgacggccttcgggttgtaaacctttttcgctgggttgaaaggccgcttttgtggtggttgattgatactggtaaagaagtaccggctaactacgtgccagcagccgcggtaatacgtagggtactagcgttgtccggttttattgggcgtaaagggcttgtaggtggtttgtcgcgtctgtcgtgaaatcccatggcttaactgtgggcttgcggtgggtacgggcaggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccatgctgtaaacgttgggcactaggtgtggggggccgttttggttttctgcgccgtagctaacgcattaagtgccccgcctggggagtacggccgcaaggctaaaactcaaaggaattgacggggacccgcacaagcggcggagcatgcggattaattcgatgcaacgcgaagaaccttaccaaggcttgacatgcaccgggcggggttttaatcgactcttctttttgctggtgtgcaggtggtgcatggttgtcgtcagctcgtgtcgtgagatgttgggttaagtcccgcaacgagcgcaacccttgtctagtgttgccagcaacattttttatggttggggactctctagggactgccggggttaactcggaggaaggtggggatgacgtcaaatcatcatgccccttatgtcttgggcttcacgcatgctacaatggatggtacagagggttgcgatactgtgaggtggagctaatctcttaaagttgttctaagttcggatagtagtctgcaattcgactgcttgaaggtggagtcgctagtaatcgcagatcagcattgctgcggtgaatacgttctcgggtcttgtacacaccgcccgtcacgtcacgaaagttggtaacgcccgaagcccgtggccttatggggagcggtcgaaggtgggattggcgattgggacgaagtcgtaacaaggtaggcgtaccggaaggtgcggctggatcacctcctttctaagga

SEQ ID NO: 11 - DNA, 1549 bp, Actinomyces hordeovulneris
  ref <308>: DATABASE ACCESSION NUMBER: NCBI ACCESSION: NZ_RQYV01000003.1
  ref <309>: DATABASE ENTRY DATE: 2019-04-01
  ref <313>: RELEVANT RESIDUES IN SEQ ID NO: (1)..(1549)
ttggagagtttgatcctggctcaggacgaacgctggcggcgtgcttaacacatgcaagtcgaacgggatctgccgggcttttgtttggtggtgagagtggcgaacgggtgagtaacacgtgagtaacctgcccccttctcttgggataacgtccagaaatgggtgctaataccggatatttacgcttcatcgcatggtggggtgtggaaaggtttttctggtgggggatgggctcgcggcctatcagcttgttggtggggtgatggcctaccaaggctttgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagtagggacgcaggcctcagtttttgttggggttgactttacttacagaagaagcgccggctaactacgtgccagcagccgcggtaatacgtagggcgcaagcgttgtccggaattattgggcgtaaagagctcgtaggcggtttgtcgcgtctgtcgtgaaaacccacagcttaactgtgggcttgcggtgggtacgggcaggcttgagtgcggtaggggagactggaattcctggtgtagcggtggaatgcacagatatcaggaggaacaccggtggcgaaggcgggtctctgggccgttactgacgctgaggagcgaaagcatggggagcgaacaggattagataccctggtagtccatgccgtaaacgttgggcactaggtgtggggaatgtttccacgttttctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacatccagagcgtgcagagatgtgcgtgcatttggttgggggtgtacaggtggtgcatggttgtcgtcagctcgtgtcgtgagatgttggagttaagtcccgcaacgagcgcaacccttgtctcatgttgccagcacgttatggtggggactcgtgagagactgccggggttaactcggaggaaggtggggatgacgtcaaatcatcatgccccttatgtcttgggcttcacgcatgctacaatggctagtacagagggttgcgatatcgtgaggttgagctaatcccttaaagctggtctcagttcggattggggtctgcaactcgaccccatgaagtcggagtcgctagtaatcgcagatcagcaacgctgcggtgaatacgttctcgggccttgtacacaccgcccgtcacgtcacgaaagttggtaacacccgaagctcatggcctaaccgtttggggggagtggtcgaaggtgggactggcgattgggacgaagtcgtaacaaggtagccgtaccggaaggtgcggctggatcacctcctttctaaggag

SEQ ID NO: 12 - DNA, 1557 bp, Actinomyces howellii
  ref <308>: DATABASE ACCESSION NUMBER: NCBI ACCESSION: NZ_LR134350.1
  ref <309>: DATABASE ENTRY DATE: 2019-04-01
  ref <313>: RELEVANT RESIDUES IN SEQ ID NO: (1)..(1557)
tgtttggagagtttgatcctggctcaggacgaacgctggcggcgtgcttaacacatgcaagtcgaacgggctgcgcctgcccttgtggtgggtgtggttagtggcgaacgggtgagtaacacgtgagtaacctgcccctcactcctggataaccgcttgaaagggtggctaatacggggtgttctggtcctgctgcatggtggggttgggaaagatgcactgttagggtgtttttggtgggggatgggctcgcggcctatcagcttgttggtggggtgatggcctaccaaggcggtgacgggtagccggcctgagagggtggacggccacactgggactgagacacggcccagactcctacgggaggcagcagtggggaatattgcacaatgggcggaagcctgatgcagcgacgccgcgtgagggatggaggccttcgggttgtgaacctctttcgccagtgaagaaggcgctcctcgttgtgggggtgttgacggtagctggataagaagcgccggctaactacgtgccagcagccgcggtaatacgtagggcgcgagcgttgtccggaattattgggcgtaaagagctcgtaggcggctggtcgcgtctgccgtgaaatcctctggcttaactgggggcgtgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtgggggctctttccggggtctccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttccggtcgcccgcggagacgtgggttcctccttgtggggccggttcacaggtggtgcatggttgtcgtcagctcgtgtcgtgagatgttgggttaagtcccgcaacgagcgcaacccttgtcccgtgttgccagcacgtcgtggtggggactcgcgggagactgccggggtcaactcggaggaaggtggggatgacgtcaaatcatcatgccccttatgtcttgggcttcacgcatgctacaatggccggtacagagggttgcgatgtcgtgaggcggagcgaatcccttaaagccggtctcagttcggatcggtgtctgcaactcgacaccgtgaagtcggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttcta

SEQ ID NO: 13 - DNA, 1555 bp, Actinomyces ihuae
  ref <308>: DATABASE ACCESSION NUMBER: NCBI ACCESSION: NZ_CZPX01000003.1
  ref <309>: DATABASE ENTRY DATE: 2019-04-01
  ref <313>: RELEVANT RESIDUES IN SEQ ID NO: (1)..(1555)
tggagagtttgatcctggctcaggacgaacgctggcggcgtgcttaacacatgcaagtcgaacgggatctgcgtggcctttgtggttgtgtggtgagagtggcgaacgggtgagtaacacgtgagtaacctgcctttttctttgggataacgctcagaaatgggtgctaatactggatgttctgcgctttccgcatggggggtgtgggaaaggggcctttgtggtttctggagggagatgggctcgcggcttatcagcttgttggtggggtgatggcttaccaaggctttgacgggtagccggcctgagagggtgggcggtcacattgggactgagatacggcccagactcctacgggaggcagcagtggggaattttgcacaatggggggaaccttgatgcagcgacgccgcgtgagggatggaggccttcgggttgtgaacctctttcgctcgtgtgcaagccgctatttgggtagtggtgagtgtagcgggtaaagaagcgccggctaactacgtgccagcagccgcggtaatacgtagggcgcgagcgttgtccggatttattgggcgtaaagggcttgtaggcggtttgtcgcgcctgtcgtgtaatcctctggcttaactgggggtgtgcggtgggtacgggcaggcttgagtgcggtaggggagattggaattcctggtgtagcggtggaatgcgcagatatcaggaggaacaccggtggcgaaggcgggtctctgggccgttactgacgctgaggagcgaaagcgtggggagcgaacaggattagataccctggtagtccatgctgtaaacgttgggcactaggtgtgggggccgcccttggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccctgagcgcctagagataggtgtgcatttggttgggggtgtgcaggtggtgcatggttgtcgtcagctcgtgtcgtgagatgttgggttaagtcccgcaacgagcgcaacccttgccctatgttgccagcgcgttatggtggggactcgtgggggactgccggggttaactcggaggaaggtggggatgacgtcaaatcatcatgccccttatgtcttgggcttcacgcatgctacaatggcaggtacagagggttgcgatgctgtgaggtggagcgaatcctttaaagcttgtctcagttcggatcggggtctgcaattcgacctcgtgaaggtggagtcgctagtaatcgcagatcagctacgctgcggtgaatacgttctcgggccttgtacacaccgcccgtcacgtcacgaaagttggtaacacccgaagcttgtggcttaacctttttggggggagcaggtgacggtgggattggcgattgggacgaagtcgtaacaaggtaggcgtaccggaaggtgcggctggatcacctcctttctagggag

SEQ ID NO: 14 - DNA, 1542 bp, Actinomyces israelii
  ref <308>: DATABASE ACCESSION NUMBER: NCBI ACCESSION: NZ_LR134357.1
  ref <309>: DATABASE ENTRY DATE: 2019-04-01
  ref <313>: RELEVANT RESIDUES IN SEQ ID NO: (1)..(1542)
ttttggagagtttgatcctggctcaggacgaacgctggcggcgtgcttaacacatgcaagtcgaacggtgaagcccagcttgctgggtggatgagtggcgaacgggtgagtaacacgtgagtaacctgcccctgacttctggataaccgcttgaaagggtggctaatacgggatattttggcctgctcgcatgggtgggtttggaaaggttctttttctggttggggatgggctcgcggcctatcagcttgttggtggggtgatggcctaccaaggctttgacgggtagccggcctgagagggtggacggccacactgggactgagacacggcccagactcctacgggaggcagcagtggggaatattgcacaatgggcgcaagcctgatgcagcgacgccgcgtgagggatgtaggccttcgggttgtgaacctctttcgccagtgaagcaggccgccttctttgtggggtggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactggaggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtgggggctctttccggggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgggtgttgatcacggagacgtggtttctcttcggagcgccttcacaggtggtgcatggttgtcgtcagctcgtgtcgtgagatgttgggttaagtcccgcaacgagcgcaacccttgtcccgtgttgccagcacgttgtggtggggactcgcgggagactgccggggttaactcggaggaaggtggggatgacgtcaaatcatcatgccccttatgtcttgggcttcacgcatgctacaatggctggtacagagggttgcgatgtcgtgaggcggagcgaatcccttaaagccagtctcagttcggatcggtgtctgcaactcgacaccgtgaagttggagtcgctagtaatcgcagatcagcaacgctgcggtgaatacgttctcgggccttgtacacaccgcccgtcacgtcatgaaagctggcaacacccgaagcccgtggccttatggggagcggtcgaaggtggggctggtgattgggacgaagtcgtaacaaggtagccgtaccggaaggtgcggctggatcacctcctttctaagga

SEQ ID NO: 15 - DNA, 1116 bp, Actinomyces liubingyangii
  ref <308>: DATABASE ACCESSION NUMBER: NCBI ACCESSION: NZ_MQSV01000012.1
  ref <309>: DATABASE ENTRY DATE: 2019-04-01
  ref <313>: RELEVANT RESIDUES IN SEQ ID NO: (1)..(1116)
cggagagtttgatcctggctcaggacgaacgctggcggcgtgcttaacacatgcaagtcgaacgatgaagcggtgcttgcaccgtggattagtggcgaacgggtgagtaacacgtgagtaacctgcccccttctttgggataagcattggaaacggtgtctaatactgaatattcacacatgggcgcatgtttgtgtgtggaaagtttttcggtgggggatgggctcgcggcctatcagcttgttggtggggtgatggcctaccaaggctttgacgggtagccggcctgagagggtgaccggtcacactgggactgagatacggcccagactcctacgggaggcagcagtggggaatattgcacaatgggcgaaagcctgatgcagcgacgccgcgtgagggatgacggccttcgggttgtaaacctctttcagtaaggacgcaggggcatctttgggtgttttgacggtacttgcagaagaagcgccggctaactacgtgccagcagccgcggtaatacgtagggcgcaagcgttgtccggaattattgggcgtaaagagcttgtaggcggtttgtcgcgtctgtcgtgaaatccagcagcttaactgttggcttgcggtgggtacgggcagactagagtgtggtaggggagactggaattcctggtgtagcggtggaatgcgcagatatcaggaggaacaccgatggcgaaggcaggtctctgggccattactgacgctgagaagcgaaagcgtggggagcgaacaggattagataccctggtagtccacgccgtaaacgttgggcactaggtgtggggggctttttggtcttctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcactggaacactgcagagatgtggtggtcttcggactggtgtacaggtggtgcatggttgtcgtcagctcgtgtcgtgagatgttgggttaagtcccgcaacgagcgcaacccttgtctcgtgttgccagcac

SEQ ID NO: 16 - DNA, 1548 bp, Actinomyces marseillensis
  ref <308>: DATABASE ACCESSION NUMBER: NCBI ACCESSION: NZ_LT707419.1
  ref <309>: DATABASE ENTRY DATE: 2019-04-01
  ref <313>: RELEVANT RESIDUES IN SEQ ID NO: (1)..(1548)
tttgttcggagagtttgatcctggctcaggacgaacgctggcggcgtgcttaacacatgcaagtcgaacgctgaaggctcagcttgctgggctggatgagtggcgaacgggtgagtaacacgtgagtaacctgccctcttctttgggataacggtcggaaacggctgctaataccgggtattcactgtccttcgcatggggggtggtggaaaggttttttctggtgggggatgggctcgcggcctatcagcttgttggtggggtgatggcttaccaaggctttgacgggtaaccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaactcaaggttgtggtgagggtagtgggtaaagaagcaccggctaactacgtgccagcagccgcggtaatacgtagggtgcgagcgttgtccggaattattgggcgtaaagggcttgtaggcggtttgtcgcgtctgccgtgaaatcctctggcttaactgggggcgtgcggtgggtacgggcagacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgttatggtggggactcgtgggggactgccggggttaactcggaggaaggtggggatgacgtcaaatcatcatgccccttatgtcttgggcttcacgcatgctacaatggctggtacagagggttgcgatactgtgaggtggagcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgtttggggggagtggtcgaaggtgggattggcgattgggacgaagtcgtaacaaggtagccgtaccggaaggtgcggctggatcacctcctttctagggag

SEQ ID NO: 17 - DNA, 1567 bp, Actinomyces massiliensis
  ref <308>: DATABASE ACCESSION NUMBER: NCBI ACCESSION: NZ_AKFT01000126.1
  ref <309>: DATABASE ENTRY DATE: 2019-04-01
  ref <313>: RELEVANT RESIDUES IN SEQ ID NO: (1)..(1567)
tttttggagagtttgatcctggctcaggacgaacgctggcggcgtgcttaacacatgcaagtcgaacgggccttgtccccttttttttgggggtggggttagtggcgaacgggtgagtaacacgtgagtaacctgcccctcacttctggataaccgcttgaaagggtggctaatacggggtgttctggcctgctcgcatgggtgggtttggaaagattcgaccggttttggttgttttggtgggggatgggctcgcggcctatcagcttgttggtggggtgatggcctgccaaggctttgacgggtagccggcctgagagggtgggcggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagaaggtcctgctctttgtggtggggttgacggtagctgggttaatgaagcgccggctaactacgtgccagcagccgcggtaatacgtagggcgcgagcgttgtccggaattattgggcgtaaagggcttgtaggcggctggtcgcgtctgccgtgaaatcctctggctcagctgggggcgtgcggtgggtacgggctggcttgagtgcggtaggggagactggaactcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggctggattgcttcggagacggggtttcccttttttgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggttaactcggaggaaggtggggatgacgtcaaatcatcatgccccttatgtcttgggcttcacgcatgctacaatggccggtacagtgggttgcgatgctgtgaggcggagcgaatccctgaaagccggtctcagttcggatcggtgtctgcaactcgacaccgtgaagttggagtcgctagtaatcgcagatcagcagcgctgcggtgaatacgttctcgggccttgtacacaccgcccgtcacgtcatgaaagctggcaacacccgaagcccgtggccttatggggagcggtcgaaggtggggctggtgattgggacgaagtcgtaacaaggtagccgtaccggaaggtgcggctggatcacctcctttctaaggag

SEQ ID NO: 18 - DNA, 1547 bp, Actinomyces minihominis
  ref <308>: DATABASE ACCESSION NUMBER: NCBI ACCESSION: NZ_FYEG01000016.1
  ref <309>: DATABASE ENTRY DATE: 2019-04-01
  ref <313>: RELEVANT RESIDUES IN SEQ ID NO: (1)..(1547)
tttttgttggagagtttgatcctggctcaggacgaacgctggcggcgtgcttaacacatgcaagtcgaacggactgcatgcaacttgttgtgtgtggttagtggcgaacgggtgagtaacacgtgagtaacctgcccccttctttgggataagcacctgaaagggtgtctaatactgattattctgcattccgcgcatgtggtttgttggaaaggtttttctggtgggggatgggctcgcggcttatcagcttgttggtggggtaatggcttaccaaggctttgacgggtaaccggcctgagagggtgaccggtcacattgggactgagatacggcccagactcctacgggaggcagcagtggggaatattgcacaatggacggaagtctgatgcagcgacgccgcgtgagggatgaaggccttcgggttgtaaacctttttcgcttttgaccaaggcaatactttggtgttgttgagggtatgaggtaaagaagctccggctaactacgtgccagcagccgcggtaatacgtagggagcgagcgttgtccggatttattgggcgtaaagggcttgtaggtggcgtgtcgcgtctgtcgtgaaattccgcagcttaactgtggtagtgcggtgggtacgggcatgcttgagtgtggtaggggagattggaattcctggtgtagcggtggaatgcgcagatatcaggaggaacaccggtggcgaaggcggatctctgggccattactgacgctgaggagcgaaagcgtggggagcgaacaggattagataccctggtagtccacgctgtaaacgttgggaactaggtgtggggcctgtcatgggttctgcgccggcgctaacgcattaagttccccgcctggggagtacggccgcaaggctaaaactcaaaggaattgacgggggcccgcacaagcggcggagcatgcggattaattcgaggcaacgcgaagaaccttaccaaggcttgacatacaccggaagcccctagaagtaggggtctctttgatactggtgtacaggtggtgcatggttgtcgtcagctcgtgtcgtgagatgttgggttaagtcccgcaacgagcgcaacccttgtcctatgttgccagcacgttatggtggggactcatgggagactgccggggttaactcggaggaaggtggggatgacgtcaaatcatcatgccccttatgtcttgggcttcacgcatgctacaatggccggtacagagggaagcgataccgtgaggtggagcggatcccttaaagccggtctcagttcggatcgaagtctgcaactcgacttcgtgaaggtggagtcgctagtaatcgcagatcagcaacgctgcggtgaatacgttctcgggccttgtacacaccgcccgtcacgtcatgaaagttggtaacacccgaagcgcgtggcctaacccttttgggggggagcgtgcgaaggtgggactggcgattgggacgaagtcgtaacaaggtagccgtaccggaaggtgtggctggatcacctcctttctaaggag

SEQ ID NO: 19 - DNA, 1551 bp, Actinomyces naeslundii
  ref <308>: DATABASE ACCESSION NUMBER: NCBI ACCESSION: NZ_PKKK01000004.1
  ref <309>: DATABASE ENTRY DATE: 2019-04-01
  ref <313>: RELEVANT RESIDUES IN SEQ ID NO: (1)..(1551)
tgtttggagagtttgatcctggctcaggacgaacgctggcggcgtgcttaacacatgcaagtcgaacggtgaagcactttccttttggtgggtgtggatgagtggcgaacgggtgagtaacacgtgagtaacctgcccccttcttctggataaccgcatgaaagtgtggctaatacgggatattctgtgcctgctgcatggtgggtgtgggaaagatattgtttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgtcccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttctaagga

SEQ ID NO: 20 - DNA, 1533 bp, Actinomyces nasicola
  ref <308>: DATABASE ACCESSION NUMBER: NCBI ACCESSION: NZ_FNQV01000009.1
  ref <309>: DATABASE ENTRY DATE: 2019-04-01
  ref <313>: RELEVANT RESIDUES IN SEQ ID NO: (1)..(1533)
tttttgcggagagtttgatcctggctcaggacgaacgctggcggcgtgcttaacacatgcaagtcgaacgggatccatttccgcttgcggttttggtgagagtggcgaacgggtgagtaacacgtgagtaacctgcccccttctttgggataactgccggaaacggtggctaatactggatattcagcaatggtcgcatggttgttgttggaaaggtttttctggtgggggatgggctcgcggcctatcagcttgttggtggggtgatggcctaccaaggctttgacgggtagccggcctgagagggtgaccggccacactgggactgagacacggcccagactcctacgggaggcagcagtggggaatattgcacaatgggggaaaccctgatgcagcgacgccgcgtgagggatgacggccttcgggttgtaaacctctttcagtagggaagaatttgacggtacctgcagaagaagcgccggctaactacgtgccagcagccgcggtaatacgtagggcgcaagcgttgtccggaattattgggcgtaaagagctcgtaggcggcttgtcgcgtctgccgtgaaaacctgcagcttaactgtgggcttgcggtgggtacgggctggcttgagtgcagtaggggagactggaattcctggtgtagcggtggaatgcgcagatatcaggaggaacaccggtggcgaaggcgggtctctgggctgttactgacgctgaggagcgaaagcatggggagcgaacaggattagataccctggtagtccatgccgtaaacgttgggcactaggtgtggggaccagttccatggtttctgtgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaatgctgcagagatgtggcagcctttgggctggtgtacaggtggtgcatggttgtcgtcagctcgtgtcgtgagatgttgggttaagtcccgcaacgagcgcaacccttgtctcatgttgccagcacgtgatggtggggactcatgagagactgccggggttaactcggaggaaggtggggatgacgtcaaatcatcatgccccttatgtcttgggcttcacgcatgctacaatggccggtacagtgggttgcgatctcgtgagggtgagctaatcccgtaaagccggtctcagttcggattggggtctgcaactcgaccccatgaagtcggagtcgctagtaatcgcagatcagcaacgctgcggtgaatacgttctcgggccttgtacacaccgcccgtcacgtcacgaaagttggtaacacccgaagctcacggcctaaccttttttggggggagtggtcgaaggtgggactggcgattgggacgaagtcgtaacaaggtagccgtaccggaaggtgcggctggatcacctcctttctaaggag

SEQ ID NO: 21 - DNA, 1547 bp, Actinomyces neuii
  ref <308>: DATABASE ACCESSION NUMBER: NCBI ACCESSION: NZ_PKKN01000013.1
  ref <309>: DATABASE ENTRY DATE: 2019-04-01
  ref <313>: RELEVANT RESIDUES IN SEQ ID NO: (1)..(1547)
tgtttggagagtttgatcctggctcaggacgaacgctggcggcgtgcttaacacatgcaagtcgaacgggatccattggtgcttgcacttttggtgagagtggcgaacgggtgagtaacacgtgagtaacctgcccttttctttgggataagcctgggaaactgggtctaatactggatgttccggcttcctcgcatggggttgttgggaaaggttttttctggattgggatgggctcgcggcttatcagcttgttggtggggtgatggcttaccaaggctttgacgggtagccggcctgagagggtggtcggtcacactgggactgagatacggcccagactcctacgggaggcagcagtgggggatattgcacaatggacgcaagtctgatgcagcgacgtcgtgtgggggatgaaggccttcgggttgtaaactcctttcgcctgcggaaaaggcagggttttggccttgttgatggtagtgggtaaagaagcgccggctaactacgtgccagcagccgcggtaatacgtagggcgcgagcgttgtccggaattattgggcgtaaagggctcgtaggcggtttgtcgcgtctagcgtttaaggctcgggcttaacccgggtttgcgttgggtacgggcaggcttgagtgcggtaggggtaactggaattcctggtgtagcggtggaatgcgcagatatcaggaggaacaccggtggcgaaggcgggttactgggccgttactgacgctgaggagcgagagcgtggggagcgaacaggattagataccctggtagtccatgctgtaaacgttgggcactaggtgtgggggctggtttcatggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgagactgcagagatgtggttgccttcggggtggtgtgcaggtggtgcatggttgtcgtcagctcgtgtcgtgagatgttgggttaagtcccgcaacgagcgcaacccttgtctcatgttgccagcacgtttgggtggggactcgtgagagactgccggggttaactcggaggaaggtggggatgacgtcaaatcatcatgccccttatgtcttgggcttcacgcatgctacattggtgtctacagagggttgctattccgtgaggttgagcgaatctcttaaagggcatcttggttcggatcgcagtctgcaactcgactgcgtgaaggtggagtcgctagtaatcgcagatcagcattgctgcggtgaatacgttctcgggccttgtacacaccgcccgtcacgtcacgaaagttggtaacacccgaagcctgtggcctaacctttttggggggagtggtcgaaggtggggctagcgattgggacgaagtcgtaacaaggtagccgtaccggaaggtgcggctggatcacctcctttctaaggag

SEQ ID NO: 22 - DNA, 1550 bp, Actinomyces odontolyticus
  ref <308>: DATABASE ACCESSION NUMBER: NCBI ACCESSION: NZ_UAPR01000011.1
  ref <309>: DATABASE ENTRY DATE: 2019-04-01
  ref <313>: RELEVANT RESIDUES IN SEQ ID NO: (1)..(1550)
tttgttcggagagtttgatcctggctcaggacgaacgctggcggcgtgcttaacacatgcaagtcgaacgctgaagctcagcttgctgggtggatgagtggcgaacgggtgagtaacacgtgagtaacctgcccccttctttgggataacgcccggaaacgggtgctaatactggatattcactgatcttcgcatgggggttggtggaaaggtttgttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaacagtggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatactgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgctttgtgcggggggagtggtcgaaggtgggattggcgattgggacgaagtcgtaacaaggtagccgtaccggaaggtgcggctggatcacctcctttctagggag

SEQ ID NO: 23 - DNA, 1563 bp, Actinomyces oricola
  ref <308>: DATABASE ACCESSION NUMBER: NCBI ACCESSION: NZ_RYFV01000018.1
  ref <309>: DATABASE ENTRY DATE: 2019-04-01
  ref <313>: RELEVANT RESIDUES IN SEQ ID NO: (1)..(1563)
tgtttggagagtttgatcctggctcaggacgaacgctggcggcgtgcttaacacatgcaagtcgaacgggccggcccttcttttttggggggttggttgagtggcgaacgggtgagtaacacgtgagtaacctgccctcttcttctggataaccgcatgaaagtgtggctaatacgggatattctggtctgcctgcatgggtgggttgggaaagattcactttggtgttttggtgggggatgggctcgcggcctatcagcttgttggtggggtgatggcctaccaaggcggtgacgggtagccggcctgagagggtgggcggtcacactgggactgagatacggcccagactcctacgggaggcagcagtgggggatattgcacaatgggcggaagcctgatgcagcgacgtcgcgtgagggatggaggccttcgggttgtgaacctctttcgccagtgaagtaggtctgctcctgtgtgggtgggttgacggtagctgggtttttaagaagcgccggctaactacgtgccagcagccgcggtgatacgtagggcgcgagcgttgtccggaattattgggcgtaaagggcttgtaggcggctggtcgcgtctgccgtgaaatcctctggcttaactgggggtgtgcggtgggtacgggtcggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccatgctgtaaacgttgggcactaggtgtggggggcctttccgggttttccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgggctggtttggtctggagacaggccgtccctttttttggggctggttcacaggtggtgcatggttgtcgtcagctcgtgtcgtgagatgttgggttaagtcccgcaacgagcgcaacccttgtctcgtgttgccagcatgttgtggtggggactcgcgggagactgccggggttaactcggaggaaggtggggatgacgtcaaatcatcatgccccttatgtcttgggcttcacgcatgctacaatggccggtacagtgggttgcgatgtcgtgaggcggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaaggtgcggctggatcacctcctttctagggag

SEQ ID NO: 24 - DNA, 1553 bp, Actinomyces oris
  ref <308>: DATABASE ACCESSION NUMBER: NCBI ACCESSION: NZ_PKKL01000007.1
  ref <309>: DATABASE ENTRY DATE: 2019-04-01
  ref <313>: RELEVANT RESIDUES IN SEQ ID NO: (1)..(1553)
tgtttggagagtttgatcctggctcaggacgaacgctggcggcgtgcttaacacatgcaagtcgaacggtgaagggaccggtttttgctggttctggatgagtggcgaacgggtgagtaacacgtgagtaacctgcccccttcttctggataaccgcatgaaagtgtggctaatacgggatattctgcgcctgctgcatggtgggtgtgggaaagatattgtttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgtcccttttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttctaagga

SEQ ID NO: 25 - DNA, 1548 bp, Actinomyces pacaensis; identical to SEQ ID NO: 16
  ref <308>: DATABASE ACCESSION NUMBER: NCBI ACCESSION: NZ_LT635457.1
  ref <309>: DATABASE ENTRY DATE: 2019-04-01
  ref <313>: RELEVANT RESIDUES IN SEQ ID NO: (1)..(1548)

SEQ ID NO: 26 - DNA, 1563 bp, Actinomyces radingae
  ref <308>: DATABASE ACCESSION NUMBER: NCBI ACCESSION: NZ_LT629792.1
  ref <309>: DATABASE ENTRY DATE: 2019-04-01
  ref <313>: RELEVANT RESIDUES IN SEQ ID NO: (1)..(1563)
tttttgtttggagagtttgatcctggctcaggacgaacgctggcggcgtgcttaacacatgcaagtcgaacgggatctgcgtggcctttgtggttgtgtggtgagagtggcgaacgggtgagtaacacgtgagtaacctgcctttttctttgggataacgctcagaaatgggtgctaatactggatgttctgcgctttccgcatggggggtgtgggaaaggggcctttgtggtttctggagggagatgggctcgcggcttatcagcttgttggtggggtgatggcttaccaaggctttgacgggtagccggcctgagagggtgggcggtcacattgggactgagatacggcccagactcctacgggaggcagcagtggggaattttgcacaatggggggaaccttgatgcagcgacgccgcgtgagggatggaggccttcgggttgtgaacctctttcgctcgtgtgcaagccgctatttgggtagtggtgagtgtagcgggtaaagaagcgccggctaactacgtgccagcagccgcggtaatacgtagggcgcgagcgttgtccggatttattgggcgtaaagggcttgtaggcggtttgtcgcgcctgtcgtgtaatcctctggcttaactgggggtgtgcggtgggtacgggcaggcttgagtgcggtaggggagattggaattcctggtgtagcggtggaatgcgcagatatcaggaggaacaccggtggcgaaggcgggtctctgggccgttactgacgctgaggagcgaaagcgtggggagcgaacaggattagataccctggtagtccatgctgtaaacgttgggcactaggtgtgggggccgcccttggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccctgagcgcctagagataggtgtgcatttggttgggggtgtgcaggtggtgcatggttgtcgtcagctcgtgtcgtgagatgttgggttaagtcccgcaacgagcgcaacccttgccctatgttgccagcgcgttatggtggggactcgtgggggactgccggggttaactcggaggaaggtggggatgacgtcaaatcatcatgccccttatgtcttgggcttcacgcatgctacaatggcaggtacagagggttgcgatgctgtgaggtggagcgaatcctttaaagcttgtctcagttcggatcggggtctgcaattcgacctcgtgaaggtggagtcgctagtaatcgcagatcagctacgctgcggtgaatacgttctcgggccttgtacacaccgcccgtcacgtcacgaaagttggtaacacccgaagcttgtggcttaacctttttggggggagcaggtgacggtgggattggcgattgggacgaagtcgtaacaaggtaggcgtaccggaaggtgcggctggatcacctcctttctagggag

SEQ ID NO: 27 - DNA, 1571 bp, Actinomyces ruminicola
  ref <308>: DATABASE ACCESSION NUMBER: NCBI ACCESSION: NZ_FNIM01000031.1
  ref <309>: DATABASE ENTRY DATE: 2019-04-01
  ref <313>: RELEVANT RESIDUES IN SEQ ID NO: (1)..(1571)
ggagagtttgatcctggctcaggacgaacgctggcggcgtgcttaacacatgcaagtcgaacgggctttcctgctggtttttgctggtgggttggttagtggcgaacgggtgagtaacacgtgagtaacctgccctcttctcctggataactgcttgaaagggcggctaatacggggtggtctggcctgcctgcatgggtgggttggtataggttcagcattttgttgttccggtgggggatgggctcgcggcttatcagcttgttggtggggtgatggcttaccaaggctttgacgggtagccggcctgagagggtggacggtcacactgggactgagatacggcccagactcctgcgggaggcagcagtggggaatattgcacaatgggcggaagcctgatgcagcgacgtcgcgtgagggatggaggccttcgggttgtgaacctctttttccggtggtgaaggcctgcttctttgtgggtgggttgacggtagccgggttaggaagcgccggctaactacgtgccagcagccgcggtaatacgtagggcgcgagcgttgtccggaattactgggcgtaaagggcttgtaggcggctggtcgcgtctgccgtgaaatcctctggcttaactgggggcttgcggtgggtacgggctggcttgagcgcggtaggggagactggaactcctggtgtagcggtggaatgcgcagatatcaggaggaacaccggtggcgaaggcgggtctctgggctgttgctgacgctgaggagcgaaagcgtggggagcgaacaggattagataccctggtagtccacgctgtaaacgttgggcactgggtgtgggggcccttttccggggtttccgcgccgtagctaacgcgttaagtgccccgcctggggagtacggccgcaaggctaaaactcaaaggaattgacgggggcccgcacaagcggcggagcatgcggattaattcgatgcaacgcgaagaaccttaccaaggcttgacatgggtcggttgctgccggagacggtggttcccttgctgcgttttgtggtttgggccggcctgcaggtggtgcatggttgtcgtcagctcgtgtcgtgagatgttgggttaagtcccgcaacgagcgcaacccctgtcccgtgttgccagcgcttttgggcggggactcgcgggagactgccggggtgaactcggaggagggtggggatgacgtcaaatcatcatgccccttatgtcttgggcttcacgcatgctacaatggccggtacagtgggttgcgatgccgtgaggcggggcgaatcccttaaagccggtctcagttcggatcggtgcctgcaactcggcaccgtgaagttggagtcgctagtaatcgcggatcagcaacgccgcggtgaatacgttctcgggccttgtacacaccgcccgtcacgtcatgaaagccggtgacgcccgaagcccgtggccctatggggagcggtcgaaggcggggctggtgattgggacgaagtcgtaacaaggtagccgtaccggaaggtgcggctggatcacctcctttctaggg

SEQ ID NO: 28 - DNA, 1559 bp, Actinomyces slackii
  ref <308>: DATABASE ACCESSION NUMBER: NCBI ACCESSION: NZ_LR134363.1
  ref <309>: DATABASE ENTRY DATE: 2019-04-01
  ref <313>: RELEVANT RESIDUES IN SEQ ID NO: (1)..(1559)
tttttggagagtttgatcctggctcaggacgaacgctggcggcgtgcttaacacatgcaagtcgaacgggctggccctggccttgtgttggggttggttagtggcgaacgggtgagtaacacgtgagtaacctgcccctcactccttggataacctcatgaaagtggggctaatacgggatgctctggtcctgctgcatggtggggtcgggaaagatgaccctttgtggtttttttggtgggggatgggctcgcggcctatcagcttgttggtggggtgatggcctaccaaggcggtgacgggtagccggcctgagagggtggacggccacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggccgcctcctgtgtggggtggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggctcaactgggggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtcagcgctggccgcagagatgtggtctcctccttgtggggcgctgtcacaggtggtgcatggttgtcgtcagctcgtgtcgtgagatgttgggttaagtcccgcaacgagcgcaacccttgtcctgtgttgccagcacgtggtggtggggactcgcgggagactgccggggtcaactcggaggaaggtggggatgacgtcaaatcatcatgccccttatgtcttgggcttcacgcatgctacaatggccggtacagagggctgcgatgccgtgaggcggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttcta

SEQ ID NO: 29 - DNA, 1587 bp, Actinomyces sp. 2119
  ref <308>: DATABASE ACCESSION NUMBER: NCBI ACCESSION: NZ_QYRR01000014.1
  ref <309>: DATABASE ENTRY DATE: 2019-04-01
  ref <313>: RELEVANT RESIDUES IN SEQ ID NO: (1)..(1587)
tttggagagtttgatcctggctcaggacgaacgctggcggcgtgcctaacacatgcaagtcgtacggtgatgcctggtccgctgttgtggtgggctgggtggatgagtggcgaacgggtgagtaacacgtgagcaacctgccctcctctcctggataacctcatgaaagtggggctaatacggggtgtgctcgtgctggtcgcatggctggtgcgggatagggcctgccttgggtgggtctggtgggggatgggctcgcggcctatcagcttgttggtggggtgagggcctaccaaggcggtgacgggtagccggcctgagagggtgggcggccacactgggactgagacacggcccagactcctgcgggaggcagcagtgggggatattgcacaatgggcgaaagcctgatgcagcgacgccgcgtgagggacggaggccttcgggtcgtgaacctctttcgccagcggagaaggtcctgcccgtggtggcggggctgacggtagctgggtaagaagcgccggctaactacgtgccagcagccgcggtaatacgtagggcgctagcgttgtccggagttactgggcgtaaagggcttgtaggcggctggtcgcgcctgccgtgaaatgtcccggctcaaccgggggagtgcggtgggtacgggccggcttgagtgcggtaggggaggccggaactcctggtgtagcggtggaatgcgcagatatcaggaggaacaccggtggcgaaggcgggtctctgggccgttactgacgctgaggagcgaaagcgtggggagcgaacaggattagataccctggtagtccgcgccgtaaacgttgggcactaggtgtggggggccttttccggggctcccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccagggcttgacatgtgggcgcgggccgcggagacgtggtcttctcctgtcctctcgtgtttgcgggggggtggggggtgccctcacaggtggtgcatggttgtcgtcagctcgtgtcgtgagatgttgggttaagtcccgcaacgagcgcaacccctgtcccgtgttgccagcacgtggtggtggggactctcgggagactgccggggtcaactcggaggagggtggggacgacgtcaaatcatcatgccccttatgtcctgggcttcacgcatgctacaatggccggtacagagggctgcggtgccgcgaggcggagcgaatcccttaaagccggtctcagttcggatcggtgtctgcaactcgacaccgtgaagccggagtcgctagtaatcgcagatcagcactgctgcggtgaatacgttctcgggccttgtacacaccgcccgtcacgtcatgaaagccggtgacgcccgaagcccgtggccctacggggagcggtcgaaggcggggctggtgattgggacgaagtcgtaacaaggtagccgtaccggaaggtgcggctggatcacctcctttcta

SEQ ID NO: 30 - DNA, 1575 bp, Actinomyces sp. 299
  ref <308>: DATABASE ACCESSION NUMBER: NCBI ACCESSION: NZ_CP025227.1
  ref <309>: DATABASE ENTRY DATE: 2019-04-01
  ref <313>: RELEVANT RESIDUES IN SEQ ID NO: (1)..(1575)
tttggagagtttgatcctggctcaggacgaacgctggcggcgtgcctaacacatgcaagtcgtacgggctgcgcctgcttttttggtgggtgtggtcagtggcgaacgggtgagtaacacgtgagcaacctgccctcctctcctggataacctcatgaaagtggggctaatacggggtgtgctcgtgctggtcgcatggctggtgcgggatagggcctgccttgggtgggtctggtgggggatgggctcgcggcctatcagcttgttggtggggtgagggcctaccaaggcggtgacgggtagccggcctgagagggtgggcggccacactgggactgagacacggcccagactcctgcgggaggcagcagtgggggatattgcacaatgggcgcaagcctgatgcagcgacgccgcgtgagggacggaggccttcgggtcgtgaacctctttcgccagcggagaaggtcctgcccgtgtggtggggctgacggtagctgggtaagaagcgccggctaactacgtgccagcagccgcggtaatacgtagggcgctagcgttgtccggagttactgggcgtaaagggcttgtaggcggctggtcgcgcctgccgtgaaatgccccggctcaaccgggggagtgcggtgggtacgggccggcttgagtgcggtaggggaggccggaactcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtgggggctcttttccggggcgcccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccagggcttgacatgtgggtgcgggccgcggagacgtggtcttctcctgccccgcttttttggtggggtggggggtgccctcacaggtggtgcatggttgtcgtcagctcgtgtcgtgagatgttgggttaagtcccgcaacgagcgcaacccctgtcccgtgttgccagcacgtggtggtggggactctcgggagactgccggggtcaactcggaggagggtggggacgacgtcaaatcatcatgccccttatgtcctgggcttcacgcatgctacaatggccggtacagagggctgcggtgccgtgaggcggagcgaatcccttaaagccggtctcagttcggatcggtgtctgcaactcgacaccgtgaagccggagtcgctagtaatcgcagatcagcactgctgcggtgaatacgttctcgggccttgtacacaccgcccgtcacgtcatgaaagccggtgacgcccgaagcccgtggccctacggggagcggtcgaaggcggggctggtgattgggacgaagtcgtaacaaggtagccgtaccggaaggtgcggctggatcacctcctttcta

SEQ ID NO: 31 - DNA, 1574 bp, Actinomyces sp. 410
  ref <308>: DATABASE ACCESSION NUMBER: NCBI ACCESSION: NZ_CP025228.1
  ref <309>: DATABASE ENTRY DATE: 2019-04-01
  ref <313>: RELEVANT RESIDUES IN SEQ ID NO: (1)..(1574)
ttgtttggagagtttgatcctggctcaggacgaacgctggcggcgtgcttaacacatgcaagtcgaacgggcctgcttgcttttttggtgggtgggttagtggcgaacgggtgagtaacacgtgagtaacctgccctcttctcctggataactgcttgaaagggcggctaatacggggtggtctggcctgcctgcatgggtgggttggtataggttcaactgtttggttgttctggtgggggatgggctcgcggcttatcagcttgttggtggggtgatggcttaccaaggctttgacgggtagccggcctgagagggtggacggtcacactgggactgagatacggcccagactcctgcgggaggcagcagtggggaatattgcacaatgggcggaagcctgatgcagcgacgtcgcgtgagggatggaggccttcgggttgtgaacctctttttccggtggtgaaggcctgctccttgttgtgggtgggttgacggtagccgggttaggaagcgccggctaactacgtgccagcagccgcggtaatacgtagggcgcgagcgttgtccggaattattgggcgtaaagggcttgtaggcggctggttgcgtctgccgtgaaatcctctggcttaactgggggcttgcggtgggtacgggctggcttgagcgcagtaggggaggctggaactcctggtgtagcggtggaatgcgcagatatcaggaggaacaccggtggcgaaggcgggtctctgggctgttgctgacgctgaggagcgaaagcgtggggagcgaacaggattagataccctggtagtccatgctgtaaacggtgggcactgggtgtgggggcccttttccggggtttctgcgccgtagctaacgcgttaagtgccccgcctggggagtacggtcgcaaggctaaaactcaaaggaattgacgggggcccgcacaagcggcggagcatgcggattaattcgatgcaacgcgaagaaccttaccaaggcttgacatgggctggttgctgccggagacggtggttcccttgctgctttttgtggtttgggctggcctgcaggtggtgcatggttgtcgtcagctcgtgtcgtgagatgttgggttaagtcccgcaacgagcgcaacccctgtctcgtgttgccagcacttcgggtggggactcgcgggagactgccggggtgaactcggaggagggtggggatgacgtcaaatcatcatgccccttatgtcttgggcttcacgcatgctacaatggccggtacagtgggttgcgatgccgtgaggcggggcgaatcccttaaagccggtctcagttcggatcggtgcctgcaactcggcaccgtgaagttggagtcgctagtaatcgcggatcagcaacgccgcggtgaatacgttctcgggccttgtacacaccgcccgtcacgtcatgaaagccggtgacgcccgaagcccgtggccttatggggagcggtcgaaggcggggctggtgattgggacgaagtcgtaacaaggtagccgtaccggaaggtgcggctggatcacctcctttctaggg

SEQ ID NO: 32 - DNA, 1574 bp, Actinomyces sp. 553; identical to SEQ ID NO: 31
  ref <308>: DATABASE ACCESSION NUMBER: NCBI ACCESSION: NZ_PPPL01000078.1
  ref <309>: DATABASE ENTRY DATE: 2019-04-01
  ref <313>: RELEVANT RESIDUES IN SEQ ID NO: (1)..(1574)

SEQ ID NO: 33 - DNA, 1557 bp, Actinomyces sp. Chiba101
  ref <308>: DATABASE ACCESSION NUMBER: NCBI ACCESSION: NZ_AP017896.1
  ref <309>: DATABASE ENTRY DATE: 2019-04-01
  ref <313>: RELEVANT RESIDUES IN SEQ ID NO: (1)..(1557)
tttgtttggagagtttgatcctggctcaggacgaacgctggcggcgtgcttaacacatgcaagtcgaacggtgatgccctggcttttgttggggtggatgagtggcgaacgggtgagtaacacgtgagtaacctgcccccttcttctggataccgccacgaaagtggtgttaatacgggatattctggctctgtcgcatggtggggttgggaaaggtcttttgtctggtgggggatgggctcgcggcctatcagcttgttggtggggtgatggcctaccaaggcgttgacgggtagccggcctgagagggtggacggccacactgggactgagacacggcccagactcctacgggaggcagcagtggggaatattgcacaatgggcggaagcctgatgcagcgacgccgcgtgagggatggaggccttcgggttgtgaacctctttcgccagtgaagcaggcccgctccttttggtgggcgggttgacggtagctggataagaagcgccggctaactacgtgccagcagccgcggtaatacgtagggcgcgagcgttgtccggaattattgggcgtaaagggcttgtaggcggctggtcgcgtctgccgtgaaatccttcggcttaaccgggggcttgcggtgggtacgggccggcttgagtgcggtaggggaggctggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtggggggcctttccgggttgtccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggatggtctcggagacggggcttcctcattttttggggtcggttcacaggtggtgcatggttgtcgtcagctcgtgtcgtgagatgttgggttaagtcccgcaacgagcgcaacccctgtcccgtgttgccagcgcgttgtggcggggactcgcgggagactgccggggtcaactcggaggagggtggggatgacgtcaaatcatcatgccccttatgtcttgggcttcacgcatgctacaatggccggtacagagggttgcgatgccgtgaggcggggcgaatcccttaaagccggtctcagttcggatcggtgtctgcaactcgacaccgtgaagttggagtcgctagtaatcgcggatcagcaacgccgcggtgaatacgttctcgggccttgtacacaccgcccgtcacgtcatgaaagtcggcaacacccgaagcccgtggccttacggggagcggtcgaaggtggggccggtgattgggacgaagtcgtaacaaggtagccgtaccggaaggtgcggctggatcacctcctttctaaggag

SEQ ID NO: 34 - DNA, 1566 bp, Actinomyces sp. CtC 72
  ref <308>: DATABASE ACCESSION NUMBER: NCBI ACCESSION: NZ_MTPX02000084.1
  ref <309>: DATABASE ENTRY DATE: 2019-04-01
  ref <313>: RELEVANT RESIDUES IN SEQ ID NO: (1)..(1566)
tggagagtttgatcctggctcaggacgaacgctggcggcgtgcttaacacatgcaagtcgaacggatcttcctgcttttttggtgggttggttagtggcgaacgggtgagtaacacgtgagtaacctgcctcttctcctggataactgcttgaaagggcggctaatacggggtggtctggcctgcctgcatgggtgggttggtataggttcaactgttttggttgttctggtgggggatgggctcgcggcttatcagcttgttggtggggtgatggcttaccaagctttgacgggtagccggcctgagagggtggacggtcacactgggactgagatacggcccagactcctgcgggaggcagcagtggggaatattgcacaatgggcggaagcctgatgcagcgacgtcgcgtgagggatggaggccttcgggttgtgaacctctttttccggtggtgaaggcttgccccttggtgggtgggttgacggtagccgggttaggaagcgccggctaactacgtgccagcagccgcggtaatacgtagggcgcgagcgttgtccggaattactgggcgtaaagggcttgtaggcggctggtcgcgtctgccgtgaaatcctctggcttaactgggggcttgcggtgggtacgggctggcttgagcgcagtaggggagactggaactcctggtgtagcggtggaatgcgcagatatcaggaggaacaccggtggcgaaggcgggtctctgggctgttgctgacgctgaggagcgaaagcgtggggagcgaacaggattagataccctggtagtccatgctgtaaacgttgggcactgggtgtgggggcccttttccggggtttccgcgccgtagctaacgcgttaagtgccccgcctggggagtacggccgcaaggctaaaactcaaaggaattgacgggggcccgcacaagcggcggagcatgcggattaattcgatgcaacgcgaagaaccttaccaaggcttgacatgggccggttgctgccggagacggtggttctctttctgctttttgtggtttgggctggtctgcaggtggtgcatggttgtcgtcagctcgtgtcgtgagatgttgggttaagtcccgcaacgagcgcaacccttgtctcgtgttgccagcacttcgggtggggactcgcgggagactgccggggtgaactcggaggaaggtggggatgacgtcaaatcatcatgccccttatgtcttgggcttcacgcatgctacaatggccggtacagtgggttgcgatgccgtgaggtggagcgaatcccttaaagccggtctcagttcggatcggtgcctgcaactcggcaccgtgaagttggagtcgctagtaatcgcggatcagcaacgccgcggtgaatacgttctcgggccttgtacacaccgcccgtcacgtcatgaaagccggtgacgcccgaagcccgtggccctatggggagcggtcgaaggcggggctggtgattgggacgaagtcgtaacaaggtagccgtaccggaaggtgcggctggatcacctcctttctaagg

SEQ ID NO: 35 - DNA, 1570 bp, Actinomyces sp. Marseille-P3109
  ref <308>: DATABASE ACCESSION NUMBER: NCBI ACCESSION: NZ_OOHN01000008.1
  ref <309>: DATABASE ENTRY DATE: 2019-04-01
  ref <313>: RELEVANT RESIDUES IN SEQ ID NO: (1)..(1570)
tgtttggagagtttgatcctggctcaggacgaacgctggcggcgtgcttaacacatgcaagtcgaacggtgaagcgccttcctttgtggtgggtgtggatgagtggcgaacgggtgagtaacacgtgagtaacctgcccccttcttctggataaccgcatgaaagtgtggctaatacgggatattctgggtctgtcgcatggtgggcctgggaaagattgcgccttttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgctcctgtgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggatggctccggagacggggtttcctctcctttgtggggggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgatgccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttctaagga

SEQ ID NO: 36 - DNA, 1541 bp, Actinomyces sp. S6-Spd3
  ref <308>: DATABASE ACCESSION NUMBER: NCBI ACCESSION: NZ_JRMV01000269.1
  ref <309>: DATABASE ENTRY DATE: 2019-04-01
  ref <313>: RELEVANT RESIDUES IN SEQ ID NO: (1)..(1541)
ggagagtttgatcctggctcaggacgaacgctggcggcgtgcttaacacatgcaagtcgaacgctgaaggctcagcttgctgggctggatgagtggcgaacgggtgagtaacacgtgagtaacctgccctcttctttgggataacggtcggaaacggctgctaataccgggtattcactgtccttcgcatggggggtggtggaaaggttttttctggtgggggatgggctcgcggcctatcagcttgttggtggggtgatggcttaccaaggctttgacgggtaaccggcctgagagggtgaccggtcacattgggactgagatacggcccagactcctacgggaggcagcagtggggaatattgcacaatgggcgaaagcctgatgcagcgacgccgcgtgagggatgaaggccttcgggttgtaaacctctttcgctcatggtcaagccgcaactcaaggttgtggtgagggtagtgggtaaagaagcaccggctaactacgtgccagcagccgcggtaatacgtagggtgcgagcgttgtccggaattattgggcgtaaagggcttgtaggcggtttgtcgcgtctgccgtgaaatcctctggcttaactgggggcgtgcggtgggtacgggcagacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgttatggtggggactcgtgggggactgccggggttaactcggaggaaggtggggatgacgtcaaatcatcatgccccttatgtcttgggcttcacgcatgctacaatggctggtacagagggttgcgatactgtgaggtggagcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgtttggggggagtggtcgaaggtgggattggcgattgggacgaagtcgtaacaaggtagccgtaccggaaggtgcggctggatcacctcctttctagggag

SEQ ID NO: 37 - DNA, 1549 bp, Actinomyces sp. UMB0138
  ref <308>: DATABASE ACCESSION NUMBER: NCBI ACCESSION: NZ_PKMC01000001.1
  ref <309>: DATABASE ENTRY DATE: 2019-04-01
  ref <313>: RELEVANT RESIDUES IN SEQ ID NO: (1)..(1549)
tgtttggagagtttgatcctggctcaggacgaacgctgacggcgtgcttaacacatgcaagtcgaacgggatccattagcgcttttgtgtttttggtgagagtggcgaacgggtgagtaacacgtgagtaacctgcccttttctttgggataagcctgggaaactgggtctaatactggatgttccggcttcctcgcatggggttgttgggaaaggttttttctggattgggatgggctcgcggcttatcagcttgttggtggggtgatggcttaccaaggctttgacgggtagccggcctgagagggtggtcggtcacactgggactgagatacggcccagactcctacgggaggcagcagtgggggatattgcacaatggacggaagtctgatgcagcgacgtcgtgtgggggatgaaggccttcgggttgtaaactcctttcgcccgcggaaaaggcagggttttggccttgttgatggtagtgggtaaagaagcgccggctaactacgtgccagcagccgcggtaatacgtagggcgcgagcgttgtccggaattattgggcgtaaagggctcgtaggcggtttgtcgcgtctagcgtttaaggctcgggcttaacccgggtttgcgttgggtacgggcaggcttgagtgcggtaggggtaactggaattcctggtgtagcggtggaatgcgcagatatcaggaggaacaccggtggcgaaggcgggttactgggccgttactgacgctgaggagcgagagcgtggggagcgaacaggattagataccctggtagtccatgctgtaaacgttgggcactaggtgtgggggctggtttcatggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgagactgcagagatgtggttgccttcggggtggtgtgcaggtggtgcatggttgtcgtcagctcgtgtcgtgagatgttgggttaagtcccgcaacgagcgcaacccttgtctcatgttgccagcacgttatggtggggactcgtgagagactgccggggttaactcggaggaaggtggggatgacgtcaaatcatcatgccccttatgtcttgggcttcacgcatgctacattggtgtctacagagggttgctattccgtgaggttgagcgaatctcttaaagggcatcttggttcggatcgcagtctgcaactcgactgcgtgaaggtggagtcgctagtaatcgcagatcagcattgctgcggtgaatacgttctcgggccttgtacacaccgcccgtcacgtcacgaaagttggtaacacccgaagcctgtggcctaacctttttggggggagtggtcgaaggtggggctagcgattgggacgaagtcgtaacaaggtagccgtaccggaaggtgcggctggatcacctcctttctaaggag

SEQ ID NO: 38 - DNA, 1549 bp, Actinomyces sp. UMB0918
  ref <308>: DATABASE ACCESSION NUMBER: NCBI ACCESSION: NZ_PNHT01000002.1
  ref <309>: DATABASE ENTRY DATE: 2019-04-01
  ref <313>: RELEVANT RESIDUES IN SEQ ID NO: (1)..(1549)
tgtttggagagtttgatcctggctcaggacgaacgctgacggcgtgcttaacacatgcaagtcgaacgggatccattagcgcttttgtgtttttggtgagagtggcgaacgggtgagtaacacgtgagtaacctgcccttttctttgggataagcctgggaaactgggtctaatactggatgttccggcttcctcgcatggggttgttgggaaaggttttttctggattgggatgggctcgcggcttatcagcttgttggtggggtgatggcttaccaaggctttgacgggtagccggcctgagagggtggtcggtcacactgggactgagatacggcccagactcctacgggaggcagcagtgggggatattgcacaatggacgaaagtctgatgcagcgacgtcgtgtgggggatgaaggccttcgggttgtaaactcctttcgcccgcggaaaaggcagggttttggccttgttgatggtagtgggtaaagaagcgccggctaactacgtgccagcagccgcggtaatacgtagggcgcgagcgttgtccggaattattgggcgtaaagggctcgtaggcggtttgtcgcgtctagcgtttaaggctcgggcttaacccgggtttgcgttgggtacgggcaggcttgagtgcggtaggggtaactggaattcctggtgtagcggtggaatgcgcagatatcaggaggaacaccggtggcgaaggcgggttactgggccgttactgacgctgaggagcgagagcgtggggagcgaacaggattagataccctggtagtccatgctgtaaacgttgggcactaggtgtgggggctggtttcatggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgagactgcagagatgtggttgccttcggggtggtgtgcaggtggtgcatggttgtcgtcagctcgtgtcgtgagatgttgggttaagtcccgcaacgagcgcaacccttgtctcatgttgccagcacgttatggtggggactcgtgagagactgccggggttaactcggaggaaggtggggatgacgtcaaatcatcatgccccttatgtcttgggcttcacgcatgctacattggtgtctacagagggttgctattccgtgaggttgagcgaatctcttaaagggcatcttggttcggatcgcagtctgcaactcgactgcgtgaaggtggagtcgctagtaatcgcagatcagcattgctgcggtgaatacgttctcgggccttgtacacaccgcccgtcacgtcacgaaagttggtaacacccgaagcctgtggcctaacctttttggggggagtggtcgaaggtggggctagcgattgggacgaagtcgtaacaaggtagccgtaccggaaggtgcggctggatcacctcctttctaaggag

SEQ ID NO: 39 - DNA, 1568 bp, Actinomyces sp. Z16
  ref <308>: DATABASE ACCESSION NUMBER: NCBI ACCESSION: NZ_CP027862.1
  ref <309>: DATABASE ENTRY DATE: 2019-04-01
  ref <313>: RELEVANT RESIDUES IN SEQ ID NO: (1)..(1568)
ggagagtttgatcctggctcaggacgaacgctggcggcgtgcttaacacatgcaagtcgaacgggctggctctggttttttgctggggttggttagtggcgaacgggtgagtaacacgtgagtaacctgccctcttctcctggataactgcttgaaagggcggctaatacggggtggtctggcctgcctgcatgggtgggttggtataggttcaactttggttgttctggtgggggatgggctcgcggcttatcagcttgttggtggggtgatggcttaccaaggctttgacgggtagccggcctgagagggtggacggtcacactgggactgagatacggcccagactcctgcgggaggcagcagtggggaatattgcacaatgggcggaagcctgatgcagcgacgtcgcgtgagggatggaggccttcgggttgtgaacctctttttccggtggtgaaggcttgcctcgtttgtgggtgggttgacggtagccgggttaggaagcgccggctaactacgtgccagcagccgcggtaatacgtagggcgcgagcgttgtccggaattactgggcgtaaagggcttgtaggcggctggtcgcgtctgccgtgaaatcctctggcttaactgggggcttgcggtgggtacgggctggcttgagcgcagtaggggagattggaactcctggtgtagcggtggaatgcgcagatatcaggaggaacaccggtggcgaaggcgggtctctgggctgttgctgacgctgaggagcgaaagcgtggggagcgaacaggattagataccctggtagtccatgctgtaaacgttgggcactgggtgtgggggcccttttccggggtttccgcgccgtagctaacgcgttaagtgccccgcctggggagtacggccgcaaggctaaaactcaaaggaattgacgggggcccgcacaagcggcggagcatgcggattaattcgatgcaacgcgaagaaccttaccaaggcttgacatgggctggttgctgccggagacggtggttctcttgctgctttttgtggtttgggctggtctgcaggtggtgcatggttgtcgtcagctcgtgtcgtgagatgttgggttaagtcccgcaacgagcgcaacccttgtctcgtgttgccagcgcgttatggcggggactcgcgggagactgccggggtgaactcggaggaaggtggggatgacgtcaaatcatcatgccccttatgtcttgggcttcacgcatgctacaatggccggtacagtgggttgcgatgccgtgaggtggagcgaatcccttaaagccggtctcagttcggatcggtgcctgcaactcggcaccgtgaagttggagtcgctagtaatcgcggatcagcaacgccgcggtgaatacgttctcgggccttgtacacaccgcccgtcacgtcatgaaagccggtgacgcccgaagcccgtggccttatggggagcggtcgaaggcggggctggtgattgggacgaagtcgtaacaaggtagccgtaccggaaggtgcggctggatcacctcctttctaggg

SEQ ID NO: 40 - DNA, 1568 bp, Actinomyces sp. Z3; identical to SEQ ID NO: 39
  ref <308>: DATABASE ACCESSION NUMBER: NCBI ACCESSION: NZ_QMIO01000057.1
  ref <309>: DATABASE ENTRY DATE: 2019-04-01
  ref <313>: RELEVANT RESIDUES IN SEQ ID NO: (1)..(1568)

SEQ ID NO: 41 - DNA, 1568 bp, Actinomyces sp. Z5; identical to SEQ ID NO: 39
  ref <308>: DATABASE ACCESSION NUMBER: NCBI ACCESSION: NZ_QMIN01000005.1
  ref <309>: DATABASE ENTRY DATE: 2019-04-01
  ref <313>: RELEVANT RESIDUES IN SEQ ID NO: (1)..(1568)

SEQ ID NO: 42 - DNA, 1569 bp, Actinomyces sp. oral taxon 170
  ref <308>: DATABASE ACCESSION NUMBER: NCBI ACCESSION: NZ_GL882513.1
  ref <309>: DATABASE ENTRY DATE: 2019-04-01
  ref <313>: RELEVANT RESIDUES IN SEQ ID NO: (1)..(1569)
ttttgtttggagagtttgatcctggctcaggacgaacgctggcggcgtgcttaacacatgcaagtcgaacggtgaagcgccttcctttgtggtgggtgtggatgagtggcgaacgggtgagtaacacgtgagtaacctgcccccttcttctggataaccgcatgaaagtgtggctaatacgggatattctgtgcctgctgcatggtgggtgtgggaaagattgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgtccctgtgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtttgcttcggagacggggtttcctcctttgtgggggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctatggggagcggtcgaaggtggggctggtgattgggacgaagtcgtaacaaggtagccgtaccggaaggtgcggctggatcacctcctttctaagga

SEQ ID NO: 43 - DNA, 1567 bp, Actinomyces sp. oral taxon 171
  ref <308>: DATABASE ACCESSION NUMBER: NCBI ACCESSION: NZ_GL637705.1
  ref <309>: DATABASE ENTRY DATE: 2019-04-01
  ref <313>: RELEVANT RESIDUES IN SEQ ID NO: (1)..(1567)
ttttgtttggagagtttgatcctggctcaggacgaacgctggcggcgtgcttaacacatgcaagtcgaacggtgaaggggcctgcttttgtgggtcctggatgagtggcgaacgggtgagtaacacgtgagtaacctgcccccttcttctggataaccgcatgaaagtgtggctaatacgggatattctgtgcctgctgcatggtgggtgtgggaaagattgtgcctttgggtgttttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgtcccttttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttctaagga

SEQ ID NO: 44 - DNA, 1111 bp, Actinomyces sp. oral taxon 181
  ref <308>: DATABASE ACCESSION NUMBER: NCBI ACCESSION: NZ_KB291546.1
  ref <309>: DATABASE ENTRY DATE: 2019-04-01
  ref <313>: RELEVANT RESIDUES IN SEQ ID NO: (1)..(1111)
cctctttcgctcatggtcaagccgcaacagtggttgtggtgagggtagtgggtaaagaagcaccggctaactacgtgccagcagccgcggtaatacgtagggtgcgagcgttgtccggaattattgggcgtaaagggcttgtaggcggtttgtcgcgtctgccgtgaaatcctctggcttaactgggggcgtgcggtgggtacgggcaggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgttatggtggggactcgtgggggactgccggggttaactcggaggaaggtggggatgacgtcaaatcatcatgccccttatgtcttgggcttcacgcatgctacaatggctggtacagagggttgcgatactgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgcttttgcggggggagtggtcgaaggtgggattggcgattgggacgaagtcgtaacaaggtagccgtaccggaaggtgcggctggatcacctcctttcta

SEQ ID NO: 45 - DNA, 1547 bp, Actinomyces sp. oral taxon 897
  ref <308>: DATABASE ACCESSION NUMBER: NCBI ACCESSION: NZ_CP027236.1
  ref <309>: DATABASE ENTRY DATE: 2019-04-01
  ref <313>: RELEVANT RESIDUES IN SEQ ID NO: (1)..(1547)
tttttggagagtttgatcctggctcaggacgaacgctggcggcgtgcttaacacatgcaagtcgaacgggcctgcccttttttgggtgggttagtggcgaacgggtgagtatcacgtgagtaacctgccccctgctcctggataacgctctgaaaggggtgctaatacggggtgtgctggtgctgccgcatggtggtgccgggataggttcccctgtttgggggttctggtgggggatgggctcgcggcctatcagcttgttggtggggtgatggcctaccaaggcggtgacgggtagccggcctgagagggtggacggccacactgggactgagacacggcccagactcctgcgggaggcagcagtggggggtattgcgcaatgggcggaagcctgacgcagcgacgccgcgtgagggacggaggccttcgggttgtgaacctctttcgccggtggagaaggcgcccccgtgtggggtgctgactgtagccgggttaagaagcgccggctaactacgtgccagcagccgcggtaatacgtagggcgcgagcgttgtccggagttactgggcgtaaagggcttgtaggcggctggtcgcgtccgccgtgaaatcccctggctcaaccgggggcgtgcggtgggtacgggccggcttgagtgcggtaggggaggctggaactcctggtgtagcggtggaatgcgcagatatcaggaagaacaccggtggcgaaggcgggtctctgggccgttactgacgctgaggagcgagagcgtggggagcgaacaggattagataccctggtagtccacgccgtaaacgttgggcactaggtgtggggggcctcttccgggtcgtccgcgccgtagctaacgcattaagtgccccgcctggggagtacggccgcaaggctaaaactcaaaggaattgacgggggcccgcacaagcggcggagcatgcggattaattcgatgcgacgcgaagaaccttaccagggcttgacatgggccggtcgtccgcggagacgcgggctcccttcggggccggtccgcaggtggtgcatggttgtcgtcagctcgtgtcgtgagatgttgggttaagtcccgcaacgagcgcaacccctgtcccgtgttgccagcacgtcgtggtggggactcgcgggagactgccggggtcaactcggaggagggtggggacgacgtcaaatcatcatgccccttatgtcctgggcttcacgcatgctacaatggccggtacagagggttgcgatgccgtgaggcggggcgaatcccttaaagccggtctcagttcggatcggtgtctgcaactcgacaccgtgaagctggagtcgctagtaatcgcggatcagcaacgccgcggtgaatacgttctcgggccttgtacacaccgcccgtcacgtcatgaaagccggtgacgcccgaagcccgtggccctacggggagcggtcgaaggcggggctggtgattgggacgaagtcgtaacaaggtagccgtaccggaaggtgcggctggatcacctcctttctag

SEQ ID NO: 46 - DNA, 1551 bp, Actinomyces sp. ph3
  ref <308>: DATABASE ACCESSION NUMBER: NCBI ACCESSION: NZ_CAGY01000009.1
  ref <309>: DATABASE ENTRY DATE: 2019-04-01
  ref <313>: RELEVANT RESIDUES IN SEQ ID NO: (1)..(1551)
tttgttcggagagtttgatcctggctcaggacgaacgctggcggcgtgcttaacacatgcaagtcgaacgctgaaggcccagcttgctgggttggatgagtggcgaacgggtgagtaacacgtgagtaacctgcccccttctttgggataacggtcggaaacggctgctaataccgggtattcactgtccttcgcatggggggtggtggaaaggttttttctggtgggggatgggctcgcggcctatcagcttgttggtggggtgatggcttaccaaggctttgacgggtaaccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaacaatggttgtggtgagggtagtgggtaaagaagcaccggctaactacgtgccagcagccgcggtaatacgtagggtgcgagcgttgtccggaattattgggcgtaaagggcttgtaggcggtttgtcgcgtctgccgtgaaatcctctggcttaactgggggcgtgcggtgggtacgggcaggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgttatggtggggactcgtgggggactgccggggttaactcggaggaaggtggggatgacgtcaaatcatcatgccccttatgtcttgggcttcacgcatgctacaatggctggtacagagggttgcgaaatcgtgaggtggagcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgtttttgcggggggagtggtcgaaggtgggattggcgattgggacgaagtcgtaacaaggtagccgtaccggaaggtgcggctggatcacctcctttctagggag

SEQ ID NO: 47 - DNA, 1548 bp, Actinomyces turicensis
  ref <308>: DATABASE ACCESSION NUMBER: NCBI ACCESSION: NZ_PKKJ01000013.1
  ref <309>: DATABASE ENTRY DATE: 2019-04-01
  ref <313>: RELEVANT RESIDUES IN SEQ ID NO: (1)..(1548)
tttgttcggagagtttgatcctggctcaggacgaacgctggcggcgtgcttaacacatgcaagtcgaacgatgatgctctggttttctggggtggattagtggcgaacgggtgagtaacacgtgagtaacctgccctcttctttgggataacggtcggaaacggctgctaatactggatattcactcattggcgcatgttggtgggtggaaaggttttttctggtgggggatgggctcgcggcctatcagcttgttggtggggtgatggcctaccaaggctttgacgggtaaccggcctgagagggtgaccggtcacattgggactgagatacggcccagactcctacgggaggcagcagtggggaattttgcacaatgggcgcaagcctgatgcagcgacgccgcgtgagggatgaaggccttcgggttgtaaacctttttcgctcatggtcaagccgcagcttgggttgtggtgagggtagtgggtaaagaagcgccggctaactacgtgccagcagccgcggtaatacgtagggcgcgagcgttgtccggaattattgggcgtaaagggcttgtaggcggttggccgcgtctgccgtgaaatcctctggcttaactgggggcgtgcggtgggtacgggttgacttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggtcgcaaggctaaaactcaaaggaattgacgggggcccgcacaagcggcggagcatgcggattaattcgatgcaacgcgaagaaccttaccaaggcttgacatgcaccctgacactgcagagatgtggtggcatttggttgggggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggttggtacagagtgttgcgatatcgtaaggtggagcgaatcacttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagctcatggcctaaccgttttggggggagtggtcgaaggtgggattggcgattgggacgaagtcgtaacaaggtagccgtaccggaaggtgcggctggatcacctcctttctagggag

SEQ ID NO: 48 - DNA, 1547 bp, Actinomyces urogenitalis
  ref <308>: DATABASE ACCESSION NUMBER: NCBI ACCESSION: NZ_PKHA01000020.1
  ref <309>: DATABASE ENTRY DATE: 2019-04-01
  ref <313>: RELEVANT RESIDUES IN SEQ ID NO: (1)..(1547)
tgtttggagagtttgatcctggctcaggacgaacgctggcggcgtgcttaacacatgcaagtcgaacggtgaagctccagcttgctggggtggatgagtggcgaacgggtgagtaacacgtgagtaacctgcccccttcttctggataactgcttgaaagggtagctaatacgggatattctggcctgctcgcatgggtgggtttggaaaggttttttctggtgggggatgggctcgcggcctatcagcttgttggtggggtgatggcctaccaaggcggtgacgggtagccggcctgagagggtggacggccacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggccatcttctttgtggggtggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtgggggctctttccggggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgagcgtctgcctcagagatggggtttcctccttgtggggcgctttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggttgcgatgtcgtgaggcggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttacggggagcggtcgaaggtggggctggtgattgggacgaagtcgtaacaaggtagccgtaccggaaggtgcggctggatcacctcctttctaaggag

SEQ ID NO: 49 - DNA, 1548 bp, Actinomyces viscosus
  ref <308>: DATABASE ACCESSION NUMBER: NCBI ACCESSION: NZ_LR134477.1
  ref <309>: DATABASE ENTRY DATE: 2019-04-01
  ref <313>: RELEVANT RESIDUES IN SEQ ID NO: (1)..(1548)
tgtttggagagtttgatcctggctcaggacgaacgctggcggcgtgcttaacacatgcaagtcgaacggtgaaggagccagcttgctggttctggatgagtggcgaacgggtgagtaacacgtgagtaacctgcccccttcttctggataaccgcatgaaagtgtggctaatacgggatattctgggtctgtcgcatggtgggcctgggaaaggtttgttccggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggatggtcctggagacggggtttcctcctttgggggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgatactgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctatggggagcggtcgaaggtggggctggtgattgggacgaagtcgtaacaaggtagccgtaccggaaggtgcggctggatcacctcctttctaggga

SEQ ID NO: 50 - DNA, 1544 bp, Actinomyces vulturis
  ref <308>: DATABASE ACCESSION NUMBER: NCBI ACCESSION: NZ_LZRK01000010.1
  ref <309>: DATABASE ENTRY DATE: 2019-04-01
  ref <313>: RELEVANT RESIDUES IN SEQ ID NO: (1)..(1544)
tttttttggagagtttgatcctggctcaggacgaacgctggcggcgtgcttaacacatgcaagtcgaacggtgaagcatccagcttgctgggtgtggatgagtggcgaacgggtgagtaacacgtgagtaacctgcccccttctcttggataactgccggaaacggtggctaatacgggatattctggccatcctgcatggggtggtttggaaaggttttttccggtgggggatgggctcgcggcctatcagcttgttggtggggtgaaggcctaccaaggcgatgacgggtagccggcctgagagggtggacggccacactgggactgagacacggcccagactcctacgggaggcagcagtggggaatattgcacaatgggcgaaagcctgatgcagcgacgccgcgtgagggatgacggccttcgggttgtaaacctctttcgctagggaagcaggccacatgtacgtgtggttgacggtacctggataagaagcgccggctaactacgtgccagcagccgcggtaatacgtagggcgcaagcgttgtccggaattattgggcgtaaagagctcgtaggcggctggtcgcgtctgtcgtgaaaacccggggctcaaccccgggcttgcggtgggtacgggccggctagagtgcggtaggggagactggaactcctggtgtagcggtggaatgcgcagatatcaggaagaacaccgatggcgaaggcaggtctctgggccgttactgacgctgaggagcgaaagcgtggggagcgaacaggattagataccctggtagtccacgccgtaaacgttgggcactaggtgtggggactctttccggggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggacacagagcctgcagagatgtgggtgcatttagttgggtgttcacaggtggtgcatggttgtcgtcagctcgtgtcgtgagatgttgggttaagtcccgcaacgagcgcaacccttgtcccgtgttgccagcacgtagtggtggggactcgcgggagactgccggggtcaactcggaggaaggtggggatgacgtcaaatcatcatgccccttatgtcttgggcttcacgcatgctacaatggccggtacagagggttgcgatactgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcacgaaagtcggcaacacccgaagcccgtggccctacggggagcggtcgaaggtggggctggtgattgggacgaagtcgtaacaaggtagccgtaccggaaggtgcggctggatcacctcctttctaaggag

SEQ ID NO: 51 - DNA, 1566 bp, Alkalibacillus haloalkaliphilus
  ref <308>: DATABASE ACCESSION NUMBER: NCBI ACCESSION: NZ_AKIF01000254.1
  ref <309>: DATABASE ENTRY DATE: 2019-04-01
  ref <313>: RELEVANT RESIDUES IN SEQ ID NO: (1)..(1566)
tttatggagagtttgatcctggctcaggacgaacgctggcggcgtgcctaatacatgcaagtcgagcgcgggaagcagacagaatccttcgggaggatgtctgtggaacgagcggcggacgggtgagtaacacgtgggcaacctgcctgtaagactgggataactccgggaaaccggggctaataccggataactcaacgaaccgcatggttcggtgttaaaagatggcttctgctattacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcatccgcaatggacgaaagtctgacggtgcaacgccgcgtgagtgatgaaggttttcggatcgtaaaactctgttgttagggaagaacacgtactgttcgaatagggcagtgccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaaggccacagctcaactgtggagggccattggaaactggggaacttgagtacagaagaggagagcggaattccacgtgtagcggtgaaatgcgtagatatgtggaggaacaccagtggcgaaggcggctctctggtctgtgactgacgctgaggcgcgaaagcatgggtagcgaacaggattagataccctggtagtccatgccgtaaacgatgagtgctaggtgttagggggtccaacccttagtgctgcagttaacgcaataagcactccgcctggggagtacggccgcaaggctgaaactcaaaggaattgacgggggcccgcacaagcggtggagcatgtggtttaattcgacgcaacgcgaagaaccttaccaggtcttgacatcttcggaccaccctagagatagggtcttcccttcggggaccgaatgacaggtggtgcatggttgtcgtcagctcgtgtcgtgagatgttgggttaagtcccgcaacgagcgcaacccttaaccttagttgccagcattcagttgggcactctaaggtgactgccggtgacaaaccggaggaaggtggggatgacgtcaaatcatcatgccccttatgacctgggctacacacgtgctacaatggatggtacaaagggaagcgaaaccgcgaggtcaagccaatcccataaagccattctcagttcggattgtaggctgcaactcgcctgcatgaagccggaatcgctagtaatcgcagatcagcatgctgcggtgaatacgttcccgggccttgtacacaccgcccgtcacaccacgagagttggcaacacccgaagtcggtggggtaaccatttatggagccagccgccgaaggtggggccaatgattggggtgaagtcgtaacaaggtagccgtatcggaaggtgcggctggatcacctcctttcta

SEQ ID NO: 52 - DNA, 407 bp, Ammoniphilus sp. CFH 90114
  ref <308>: DATABASE ACCESSION NUMBER: NCBI ACCESSION: NZ_SDLI01000056.1
  ref <309>: DATABASE ENTRY DATE: 2019-04-01
  ref <313>: RELEVANT RESIDUES IN SEQ ID NO: (1)..(407)
tggcaagcgttgtccggatttattgggcgtaaagcgagcgcaggcggttttttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggag

SEQ ID NO: 53 - DNA, 1090 bp, Amphibacillus marinus
  ref <308>: DATABASE ACCESSION NUMBER: NCBI ACCESSION: NZ_FODJ01000029.1
  ref <309>: DATABASE ENTRY DATE: 2019-04-01
  ref <313>: RELEVANT RESIDUES IN SEQ ID NO: (1)..(1090)
gaggtaaaaggcggcttttagctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaacacgtaccgttcaaatagggcggtaccttgacggtacctaacgagaaagccccggctaactacgtgccagcagccgcggtaatacgtagggggcaagcgttgtccggaattattgggcgtaaagcgcgcgcaggcggttttttaagtctgatgtgaaatcttgcggctcaaccgcaagcggtcattggaaactggagaacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctcatgaaagctctagagatagagtcggcccttcggggacatgagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaagccgtgaggtgaagcaaa

SEQ ID NO: 54 - DNA, 1396 bp, Aneurinibacillus soli
  ref <308>: DATABASE ACCESSION NUMBER: NCBI ACCESSION: NZ_QJSZ01000041.1
  ref <309>: DATABASE ENTRY DATE: 2019-04-01
  ref <313>: RELEVANT RESIDUES IN SEQ ID NO: (1)..(1396)
gggataacttcgggaaaccgaagctaataccgaatacgacattagcccgcatgggctgatgtggaaagaccttgtgtcacgtacagatgggcctgcggcgcattagctagttggtggggtagaggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgtaagggaagaaccgccgggatgacctcccggtctgacggtaccttacgagaaagccccggctaactacgtgccagcagccgcggtaatacgtagggggcaagcgttgtccggaattattgggcgtaaagcgcgcgcaggcggttttctaagttaggtgtgaaagcccacggctcaaccgtggagggccacctaaaactgggagacttgagtgcaggagaggagagcggaattccacgtgtagcggtgaaatgcgtagagatgtggaggaacacccgtggcgaaggcggctctctggcctgtaactgacgctgaggcgcgaaagcgtggggagcaaacaggattagataccctggtagtccacgccgtaaacgatgagtgctaggtgttggggactccaatcctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccagggcttgacatccctctgaaatctctagagatagaggctcccttcggggcagaggtgacaggtggtgcatggttgtcgtcagctcgtgtcgtgagatgttgggttaagtcccgcaacgagcgcaacccttgtccttagttgccagcattcagttgggcactctagggagactgccgtcgacaagacggaggaaggtggggatgacgtcaaatcatcatgccccttatgtcctgggctacacacgtgctacaatggatggaacaacgggcagccaactcgcgagagtgcgcaaatcccttaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaaccgcaaggagccagccgccgaaggtggggtagatgattggggtgaagtcgtaacaaggtatccgtaccggaaggtgcggatggatcacctcctttct

SEQ ID NO: 55 - DNA, 238 bp, Aneurinibacillus thermoaerophilus
  ref <308>: DATABASE ACCESSION NUMBER: NCBI ACCESSION: NZ_FNDE01000030.1
  ref <309>: DATABASE ENTRY DATE: 2019-04-01
  ref <313>: RELEVANT RESIDUES IN SEQ ID NO: (1)..(238)
ttttttggagagtttgatcctggctcaggacgaacgctggcggcgtgcctaatacatgcaagtcgagcgaaccgatggagtgcttgcattcctgaggttagcggcggacgggtgagtaacacgtaggcaacctgcctgtacgaccgggataactccgggaaaccggagctaataccggataggatgccgaaccgcatggttcggcatggaaaggcctttgagccgcgtacagatgggc

SEQ ID NO: 56 - DNA, 1387 bp, Anoxybacillus flavithermus
  ref <308>: DATABASE ACCESSION NUMBER: NCBI ACCESSION: NZ_SBBW01000138.1
  ref <309>: DATABASE ENTRY DATE: 2019-04-01
  ref <313>: RELEVANT RESIDUES IN SEQ ID NO: (1)..(1387)
tcgttagcggcggacgggtgagtaacacgtgggcaacctgccctgtagacggggataacaccgagaaatcggtgctaataccggataacacgaaatgtcgcatgacgtttcgttgaaagacggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaacgcagtaactggcgttaccgtgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccgccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgcc

SEQ ID NO: 57 - DNA, 1559 bp, Anoxybacillus kamchatkensis
  ref <308>: DATABASE ACCESSION NUMBER: NCBI ACCESSION: NZ_CP025535.1
  ref <309>: DATABASE ENTRY DATE: 2019-04-01
  ref <313>: RELEVANT RESIDUES IN SEQ ID NO: (1)..(1559)
tctatggagagtttgatcctggctcaggacgaacgctggcggcgtgcctaatacatgcaagtcgagcggacgattcaaaagcttgcttttggatcgttagcggcggacgggtgagtaacacgtgggcaacctgccctgtagacggggataacaccgagaaatcggtgctaataccggataacacgaaaggtcgcatggtctttcgttgaaagacggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaccgcagtcactggcggtaccttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcgggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaaatgattggggtgaagtcgtaacaaggtagccgtatcggaaggtgcggctggatcacctcctttct

SEQ ID NO: 58 - DNA, 1562 bp, Anoxybacillus pushchinoensis
  ref <308>: DATABASE ACCESSION NUMBER: NCBI ACCESSION: NZ_FOJQ01000117.1
  ref <309>: DATABASE ENTRY DATE: 2019-04-01
  ref <313>: RELEVANT RESIDUES IN SEQ ID NO: (1)..(1562)
ttctatggagagtttgatcctggctcaggacgaacgctggcggcgtgcctaatacatgcaagtcgagcggacgattcgaaagcttgcttttgaatcgttagcggcggacgggtgagtaacacgtgggcaacctgccctgtagacggggataacaccgagaaatcggtgctaataccggataacacgaaatgtcgcatgacgtttcgttgaaaggcggcgcaagctgccgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaacgtagtaactggcgttactatgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcgagtcaagtcgggcactctaaggtgactgccggctaaaagtcggaggaaggtggggatgacgtcaaatcatcatgccccttatgacctgggctacacacgtgctacaatgggcggtacaaagggttgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaaatgattggggtgaagtcgtaacaaggtagccgtatcggaaggtgcggctggatcacctcctttcta

SEQ ID NO: 59 - DNA, 1294 bp, Anoxybacillus vitaminiphilus
  ref <308>: DATABASE ACCESSION NUMBER: NCBI ACCESSION: NZ_QLMH01000054.1
  ref <309>: DATABASE ENTRY DATE: 2019-04-01
  ref <313>: RELEVANT RESIDUES IN SEQ ID NO: (1)..(1294)
ttttcggttgaaaggcggctttggctgtcactgcaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcgacgccgcgtgagcgaagaaggccttcgggtcgtaaagctctgttgtcagggaagaacaagtaccgttcgaacagggcggtaccttgacggtacctgacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtttccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaaccctagagatagggcgttccccttcgggggacagggtgacaggtggtgcatggttgtcgtcagctcgtgtcgtgagatgttgggttaagtcccgcaacgagcgcaaccctcgaccttagttgccagcattgagttgggcactctaaggtgactgccggctaaaagtcggaggaaggtggggatgacgtcaaatcatcatgccccttatgacctgggctacacacgtgctacaatgggcggtacaaagggttgcgaagccgcgaggtggagctaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaa

SEQ ID NO: 60 - DNA, 1554 bp, Bacillus acanthi
  ref <308>: DATABASE ACCESSION NUMBER: NCBI ACCESSION: NZ_QBBX01000049.1
  ref <309>: DATABASE ENTRY DATE: 2019-04-01
  ref <313>: RELEVANT RESIDUES IN SEQ ID NO: (1)..(1554)
tttttggagagtttgatcctggctcaggacgaacgctggcggcgtgcctaatacatgcaagtcgagcggattgatgggagcttgctccctgatatcagcggcggacgggtgagtaacacgtgggcaacctgcctgtaagactgggataactccgggaaaccggggctaataccggatagtttttctccttgcataaggagaaagggaaagacggtttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaccatcctagagataggaccttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagagtcgcaaacccgcgagggctagctaatctcataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 61 - DNA, 645 bp, Bacillus acidiceler
  ref <308>: DATABASE ACCESSION NUMBER: NCBI ACCESSION: NZ_SCFN01000061.1
  ref <309>: DATABASE ENTRY DATE: 2019-04-01
  ref <313>: RELEVANT RESIDUES IN SEQ ID NO: (1)..(645)
gagcgatgaaggccttcgggtcgtaaagctctgttgttagggaagaataagtgctagttgaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacagg

SEQ ID NO: 62 - DNA, 1551 bp, Bacillus aerophilus
  ref <308>: DATABASE ACCESSION NUMBER: NCBI ACCESSION: NZ_CP026008.1
  ref <309>: DATABASE ENTRY DATE: 2019-04-01
  ref <313>: RELEVANT RESIDUES IN SEQ ID NO: (1)..(1551)
ttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttct

SEQ ID NO: 63 - DNA, 1555 bp, Bacillus albus
  ref <308>: DATABASE ACCESSION NUMBER: NCBI ACCESSION: NZ_SEIR01000425.1
  ref <309>: DATABASE ENTRY DATE: 2019-04-01
  ref <313>: RELEVANT RESIDUES IN SEQ ID NO: (1)..(1555)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttct

SEQ ID NO: 64 - DNA, 1561 bp, Bacillus alkalitelluris
  ref <308>: DATABASE ACCESSION NUMBER: NCBI ACCESSION: NZ_KZ119600.1
  ref <309>: DATABASE ENTRY DATE: 2019-04-01
  ref <313>: RELEVANT RESIDUES IN SEQ ID NO: (1)..(1561)
tttattggagagtttgatcctggctcaggacgaacgctggcggcgtgcctaatacatgcaagtcgagcggacttctttaaagcttgctttagagaagttagcggcggacgggtgagtaacacgtgggcaacctgccttacagactgggataacttcgggaaaccgaagctaataccggatgatcaaatgaaccgcatggttcaattgtaaaagttgggatttatcctaacactgtgagatgggcccgcggcgcattagctagttggtgaggtaacggctcaccaaggcaacgatgcgtagccgacctgagagggtgatcggccacactggaactgagacacggtccagactcctacgggaggcagcagtagggaatcatccgcaatgggcgaaagcctgacggtgcaacgccgcgtgaacgatgaaggtcttcggattgtaaagttctgttgttagggaagaacaagtgccattcgaataggttggcaccttgacggtacctaaccagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggggacttgagtgtaggagaggaaagtggaattccacgtgtagcggtgaaatgcgtagatatgtggaggaacaccagtggcgaaggcgactttctggcctacaactgacgctgaggcgcgaaagcgtggggagcaaacaggattagataccctggtagtccacgccgtaaacgatgagtgctaggtgttaggggtttcgatgcccttagtgccgcagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgccactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggttgagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagcttgtaacacccgaagtcggtgccgtaaccttttaggagcgagccgccgaaggtgggacaggtgattggggtgaagtcgtaacaaggtatccctaccggaaggtggggatggatcacctcctttctaa

SEQ ID NO: 65 - DNA, 1548 bp, Bacillus altitudinis
  ref <308>: DATABASE ACCESSION NUMBER: NCBI ACCESSION: NZ_QENO01000017.1
  ref <309>: DATABASE ENTRY DATE: 2019-04-01
  ref <313>: RELEVANT RESIDUES IN SEQ ID NO: (1)..(1548)
tcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttct

SEQ ID NO: 66 - DNA, 1476 bp, Bacillus amyloliquefaciens
  ref <308>: DATABASE ACCESSION NUMBER: NCBI ACCESSION: NZ_OFHT01000008.1
  ref <309>: DATABASE ENTRY DATE: 2019-04-01
  ref <313>: RELEVANT RESIDUES IN SEQ ID NO: (1)..(1476)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggtttcagacataaaaggtggcttcgtctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggccggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccgactcaaccggggagggtcattggaaactggggaacttgagtgcagaagaggagagtggaattccacgtgtagcggtgaaatgcgtatagatatgaggaggaacaccaagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggccagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaattcatcatgccccttatgacctgggctacacacgtgctacaattgaacagaacaaagggcagcgaaaccgcgaggttaagccaatcccaccaattctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagc

SEQ ID NO: 67 - DNA, 1670 bp, Bacillus andreraoultii
  misc_feature (3)..(3): n is a, c, g, or t
  ref <308>: DATABASE ACCESSION NUMBER: NCBI ACCESSION: NZ_LN868937.1
  ref <309>: DATABASE ENTRY DATE: 2019-04-01
  ref <313>: RELEVANT RESIDUES IN SEQ ID NO: (1)..(1670)
gtntgatcctggctcaggacgaacgctggcggcgtgcctaatacatgcaagtcgagcggatcttttaaaagcttgcttttaaaagattagcggcggacgggtgagtaacacgtgggtaacctacctataagactgggataactccgggaaaccggtgctaataccagatagttttctagctcgcatgagttagaaaggaaagatggtttcggctatcacttatagatggacccgcggcgcattagctagttggtgaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtatcggagtaactgccggtaccttgacggtacctttcgaggaagccacggctaactacgtgccagcagccgcggtaatacgtaggtggcaagcgttgtccggatttattgggcgtaaagcgcgcgcaggcggtcctttaagtctgatgtgaaatcttacggctcaaccgtaagcggtcattggaaactggggggcttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatctcctgaccgccctggagacagggttttcccttcggggacaggatgacaggtggtgcatggttgtcgtcagctcgtgtcgtgagatgttgggttaagtcccgcaacgagcgcaacccttgattctagttgccagcattcagttgggcactctagagtgactgccggcgacaagtcggaggaaggtggggatgacgtcaaatcatcatgccccttatgacctgggctacacacgtgctacaatggatggtacaaagggttgcaaagccgcgaggctaagctaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacggagcagaggtcagaggccagaagtgtgaggtcagaatgaaggcaatttcaaagaggtgaagatttttagttacttcttagagatgacttacatccgacttctgacatctgatttctgacttctgttccgggccagccgccgaaggtgggacagatgattggggtgaagtcgtaacaaggtagccgtatcggaaggtgcggctggatcacctcctttctaagga

SEQ ID NO: 68 - DNA, 1484 bp, Bacillus aquimaris
  ref <308>: DATABASE ACCESSION NUMBER: NCBI ACCESSION: NZ_QNRJ01000047.1
  ref <309>: DATABASE ENTRY DATE: 2019-04-01
  ref <313>: RELEVANT RESIDUES IN SEQ ID NO: (1)..(1484)
tgatgggagcttgctcccatcagtcagcggcggacgggtgagtaacacgtgggtaacctgcctgtaagactgggataactccgggaaaccggggctaataccggataactcatttcctcgcatgaggaaatgttgaaaggtggcttttagctatcacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggacggtacaaagggcagcaagaccgcgaggtttagccaatcccataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 69 - DNA, 832 bp, Bacillus aryabhattai
gcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattgg

SEQ ID NO: 70 - DNA, 1552 bp, Bacillus aryabhattai
ttcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttct

SEQ ID NO: 71 - DNA, 1552 bp, Bacillus aryabhattai
ttcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggccacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttct

SEQ ID NO: 72 - DNA, 1482 bp, Bacillus aryabhattai
gattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttct

SEQ ID NO: 73 - DNA, 1552 bp, Bacillus aryabhattai
ttcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttct

SEQ ID NO: 74 - DNA, 1553 bp, Bacillus aryabhattai
  ref <308>: DATABASE ACCESSION NUMBER: NCBI ACCESSION: NZ_CP024035.1
  ref <309>: DATABASE ENTRY DATE: 2019-04-01
  ref <313>: RELEVANT RESIDUES IN SEQ ID NO: (1)..(1553)
tcggagagtttgatcctggctcaggatgaacgctggcggcgtgcctaatacatgcaagtcgagcgaactgattagaagcttgcttctaagacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttctaa

SEQ ID NO: 75 - DNA, 1074 bp, Bacillus aryabhattai
gtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttcta

SEQ ID NO: 76 - DNA, 1552 bp, Bacillus asahii
  ref <308>: DATABASE ACCESSION NUMBER: NCBI ACCESSION: NZ_CP026095.1
  ref <309>: DATABASE ENTRY DATE: 2019-04-01
  ref <313>: RELEVANT RESIDUES IN SEQ ID NO: (1)..(1552)
tatcggagagtttgatcctggctcaggacgaacgctggcggcgtgcctaatacatgcaagtcgagcgaatcaatgggagcttgctccctgagattagcggcggacgggtgagtaacacgtgggtaacctgcctgtaagactgggataacttcgggaaaccggagctaataccggatactttcttttctcgcatgagagaagatggaaagatggtttcggctatcacttgcagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgccaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagagctgcgaacccgcgagggtaagcgaatctcataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttcta

SEQ ID NO: 77 - DNA, 1553 bp, Bacillus atrophaeus
  ref <308>: DATABASE ACCESSION NUMBER: NCBI ACCESSION: NZ_PVWA01000011.1
  ref <309>: DATABASE ENTRY DATE: 2019-04-01
  ref <313>: RELEVANT RESIDUES IN SEQ ID NO: (1)..(1553)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacacccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgagaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttcta

SEQ ID NO: 78 - DNA, 1559 bp, Bacillus badius
  ref <308>: DATABASE ACCESSION NUMBER: NCBI ACCESSION: NZ_MWMM01000038.1
  ref <309>: DATABASE ENTRY DATE: 2019-04-01
  ref <313>: RELEVANT RESIDUES IN SEQ ID NO: (1)..(1559)
tttttggagagtttgatcctggctcaggacgaacgctggcggcgtgcctaatacatgcaagtcgagcggacttgacggaagcttgcttccgttcaagttagcggcggacgggtgagtaacacgtgggtaacctgcctgtaagactgggataactccgggaaaccggggctaataccggatattctttttcttcgcatgaagaagaatggaaaggcggcttttagctgtcgcttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtacggaagtaactgtccgtaccttgacggtacctgaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtctggagacaggcctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcaaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgcctaaggtggggcagatgattggggtgaagtcgtaacaaggtagccgtatcggaaggtgcggctggatcacctcctttcta

SEQ ID NO: 79 - DNA, 1358 bp, Bacillus bataviensis
  ref <308>: DATABASE ACCESSION NUMBER: NCBI ACCESSION: NZ_AJLS01000166.1
  ref <309>: DATABASE ENTRY DATE: 2019-04-01
  ref <313>: RELEVANT RESIDUES IN SEQ ID NO: (1)..(1358)
ggaaaaactgaaagacggtttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 80 - DNA, 1556 bp, Bacillus bingmayongensis
  ref <308>: DATABASE ACCESSION NUMBER: NCBI ACCESSION: NZ_JH921521.1
  ref <309>: DATABASE ENTRY DATE: 2019-04-01
  ref <313>: RELEVANT RESIDUES IN SEQ ID NO: (1)..(1556)
ctttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataatattttgcgcctcatgacgcaaaattgaaaggcggcttcggctgtcacttatggatggacccgcgtcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 81 - DNA, 1551 bp, Bacillus butanolivorans
  ref <308>: DATABASE ACCESSION NUMBER: NCBI ACCESSION: NZ_CP030926.1
  ref <309>: DATABASE ENTRY DATE: 2019-04-01
  ref <313>: RELEVANT RESIDUES IN SEQ ID NO: (1)..(1551)
tcggagagtttgatcctggctcaggacgaacgctggcggcgtgcctaatacatgcaagtcgagcgaatctcagggagcttgctccctgagattagcggcggacgggtgagtaacacgtgggcaacctgcctataagactgggataacttcgggaaaccggagctaataccggatacgttcttttctcgcatgagagaagatggaaagacggcctctagctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctttatggagccagccgcctaaggtgggacagatgattggggtgaagtcgtaacaaggtagccgtatcggaaggtgcggctggatcacctcctttct

SEQ ID NO: 82 - DNA, 1024 bp, Bacillus camelliae
  ref <308>: DATABASE ACCESSION NUMBER: NCBI ACCESSION: NZ_PIQO01000061.1
  ref <309>: DATABASE ENTRY DATE: 2019-04-01
  ref <313>: RELEVANT RESIDUES IN SEQ ID NO: (1)..(1024)
gtaaaactctgttgttagagaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgctaaccctagagatagggcgttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaac

SEQ ID NO: 83 - DNA, 1553 bp, Bacillus canaveralius
  ref <308>: DATABASE ACCESSION NUMBER: NCBI ACCESSION: NZ_RWHA01000069.1
  ref <309>: DATABASE ENTRY DATE: 2019-04-01
  ref <313>: RELEVANT RESIDUES IN SEQ ID NO: (1)..(1553)
tttttggagagtttgatcctggctcaggacgaacgctggcggcgtgcctaatacatgcaagtcgagcggacgtgcgggagcttgctcccgttcgtcagcggcggacgggtgagtaacacgtgggcaacctgcctgtaagactgggataacttcgggaaaccggagctaataccggataatccattccctcacctgagggaatgctgaaagacggtttcggctgtcacttacagatgggcccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtattggagtaactgccagtaccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggaaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgaaaccgcgaggtggagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 84 - DNA, 1555 bp, Bacillus caseinilyticus
  ref <308>: DATABASE ACCESSION NUMBER: NCBI ACCESSION: NZ_FNPI01000055.1
  ref <309>: DATABASE ENTRY DATE: 2019-04-01
  ref <313>: RELEVANT RESIDUES IN SEQ ID NO: (1)..(1555)
tttatcggagagtttgatcctggctcaggacgaacgctggcggcgtgcctaatacatgcaagtcgagcggaccaaaggaagcttgcttccggaggtcagcggcggacgggtgagtaacacgtgggcaacctgccttacagactgggataactccgggaaaccggggctaataccggatgaccgatgggaccgcatggtcctgtcgtaaaagttgggattactaacactgtaagatgggcccgcggcgcattagctagttggtgaggtaacggctcaccaaggcgacgatgcgtagccgacctgagagggtgatcggccacactgggactgagacacggcccagactcctacgggaggcagcagtagggaatcatccgcaatgggcgaaagcctgacggtgcaacgccgcgtgaacgaggaaggtcttcggattgtaaagttctgttgtcagggaagaagaagtgccattcgaacaggttggcaccgtgacggtacctgacgagaaagccccggctaactacgtgccagcagccgcggtaatacgtagggggcaagcgttgtccggaattattgggcgtaaagcgcgcgcaggcggtttcttaagtctgatgtgaaagcccacggctcaaccgtggagggtcattggaaactgggagacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttaggggtttcgatacccttagtgccgcagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgccactcctggagacaggacgttccccttcgggggacagagtgacaggtggtgcatggttgtcgtcagctcgtgtcgtgagatgttgggttaagtcccgcaacgagcgcaacccttgatcttagttgccagcattgagttgggcactctaaggtgactgccggtgacaaaccggaggaaggtggggatgacgtcaaatcatcatgccccttatgacctgggctacacacgtgctacaatgggtggtacaaagggcagcaacgccgcgaggccgagcgaatcccagaaagccactctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtatccctaccggaaggtggggatggatcacctcctttctaa

SEQ ID NO: 85 - DNA, 1397 bp, Bacillus cavernae
  ref <308>: DATABASE ACCESSION NUMBER: NCBI ACCESSION: NZ_RYZZ01000039.1
  ref <309>: DATABASE ENTRY DATE: 2019-04-01
  ref <313>: RELEVANT RESIDUES IN SEQ ID NO: (1)..(1397)
tccccgtagtcagcggcggacgggtgagtaacacgtgggcaacctgcctgtaagactgggataacttcgggaaaccggagctaataccggatagattctgctctcgcatgagaggagagggaaagatggtttacgctatcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacacgtaccagagtaactgctggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacgcccctagagatagggagttccccttcgggggacagagtgacaggtggtgcatggttgtcgtcagctcgtgtcgtgagatgttgggttaagtcccgcaacgagcgcaacccttgatcttagttgccagcattgagttgggcactctaaggtgactgccggtgacaaaccggaggaaggtggggatgacgtcaaatcatcatgccccttatgacctgggctacacacgtgctacaatggatggtacaaagggcagcaaagccgcaaggcctagcgaatcccagaaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccatttggagccagccgcctaaggtgg

SEQ ID NO: 86 - DNA, 1551 bp, Bacillus cellulasensis
  ref <308>: DATABASE ACCESSION NUMBER: NCBI ACCESSION: NZ_CP018574.1
  ref <309>: DATABASE ENTRY DATE: 2019-04-01
  ref <313>: RELEVANT RESIDUES IN SEQ ID NO: (1)..(1551)
ttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgataaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttct

SEQ ID NO: 87 - DNA, 1561 bp, Bacillus cellulosilyticus
  ref <308>: DATABASE ACCESSION NUMBER: NCBI ACCESSION: NC_014829.1
  ref <309>: DATABASE ENTRY DATE: 2019-04-01
  ref <313>: RELEVANT RESIDUES IN SEQ ID NO: (1)..(1561)
attttttggagagtttgatcctggctcaggacgaacgctggcggcgtgcctaatacatgcaagtcgagcggatcaattaagagcttgctcttatgagatcagcggcggacgggtgagtaacacgtgggcaacctgccttacagactgggataactccgggaaaccgaagctaataccggatgatcaatggaaccgcatggttctattgtaaaagttgggagcaatcctaacactgtgagatgggcccgcggcgcattagctagttggtgaggtaatggctcaccaaggcaacgatgcgtagccgacctgagagggtgatcggccacactggaactgagacacggtccagactcctacgggaggcagcagtagggaatcatccgcaatgggcgaaagcctgacggtgcaacgccgcgtgaacgatgaaggtcttcggattgtaaagttctgttgttagggaagaacaagtgccattcaaataggttggcaccttgacggtacctaaccagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggggacttgagtgtaggagaggaaagtggaattccacgtgtagcggtgaaatgcgtagatatgtggaggaacaccagtggcgaaggcgactttctggcctacaactgacgctgaggcgcgaaagcgtggggagcaaacaggattagataccctggtagtccacgccgtaaacgatgagtgctaggtgttaggggtttcgatacccttagtgccgcagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggtggtacaaagggcagcaaagccgcgaggccgagcgaatcccataaagccactctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtatccctaccggaaggtggggatggatcacctcctttctaa

SEQ ID NO: 88 - DNA, 1556 bp, Bacillus cereus
  ref <308>: DATABASE ACCESSION NUMBER: NCBI ACCESSION: NZ_UFSU01000001.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaaattagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 89 - DNA, 1552 bp, Bacillus circulans
  ref <308>: DATABASE ACCESSION NUMBER: NCBI ACCESSION: NZ_CP026033.1
  ref <309>: DATABASE ENTRY DATE: 2019-04-01
  ref <313>: RELEVANT RESIDUES IN SEQ ID NO: (1)..(1552)
tttattggagagtttgatcctggctcaggacgaacgctggcggcgtgcctaatacatgcaagtcgagcggactttaaaagcttgcttttaaagttagcggcggacgggtgagtaacacgtgggcaacctgcctgtaagactgggataacttcgggaaaccggagctaataccggataatccttttcctctcatgaagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggatagatgattggggtgaagtcgtaacaaggtagccgtatcggaaggtgcggctggatcacctcctttcta

SEQ ID NO: 90 - DNA, 1554 bp, Bacillus cohnii
  ref <308>: DATABASE ACCESSION NUMBER: NCBI ACCESSION: NZ_CP018866.1
  ref <309>: DATABASE ENTRY DATE: 2019-04-01
  ref <313>: RELEVANT RESIDUES IN SEQ ID NO: (1)..(1554)
tacggagagtttgatcctggctcaggacgaacgctggcggcgtgcctaatacatgcaagtcgagcgaacttctttagagcttgctttaaagaagttagcggcggacgggtgagtaacacgtgggcaacctgcctgtaagactgggataacttcgggaaaccggagctaataccggataatatatagtacctcctggtactatattgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccacctctagagatagagcgttccccttcgggggacagagtgacaggtggtgcatggttgtcgtcagctcgtgtcgtgagatgttgggttaagtcccgcaacgagcgcaacccttgttcttagttgccagcatttagttgggcactctaaggagactgccggtgacaaaccggaggaaggtggggatgacgtcaaatcatcatgccccttatgacctgggctacacacgtgctacaatggacggtacaaagggcagcaaaaccgcgaggtcgagccaatcccataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 91 - DNA, 804 bp, Bacillus cucumis
cacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagatagga

SEQ ID NO: 92 - DNA, 1547 bp, Bacillus cucumis
  ref <308>: DATABASE ACCESSION NUMBER: NCBI ACCESSION: NZ_PGVE01000101.1
  ref <309>: DATABASE ENTRY DATE: 2019-04-01
  ref <313>: RELEVANT RESIDUES IN SEQ ID NO: (1)..(1547)
ttcttggagagtttgatcctggctcaggacgaacgctggcggcgtgcctaatacatgcaagtcgagcgaatcaataggagcttgctcctgttggttagcggcggacgggtgagtaacacgtgggcaacctgcctgtaagactgggataacaccgggaaaccggtgctaataccggataatccttttcctcacatgagggaaagctgaaagtcggtttcggctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaagccgcgaggcctagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaagagtttacggagtaaacttacttcgtaagcattgtcctaggagccagccgcctaaggtgggacagatgattggggtgaagtcgtaa

SEQ ID NO: 93 - DNA, 1288 bp, Bacillus cytotoxicus
  ref <308>: DATABASE ACCESSION NUMBER: NCBI ACCESSION: NZ_FMIK01000071.1
  ref <309>: DATABASE ENTRY DATE: 2019-04-01
  ref <313>: RELEVANT RESIDUES IN SEQ ID NO: (1)..(1288)
acggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtatgagttgaataagctcatgccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactgggagacttgagtgcagaagaggagagtggaattccatgtgtagcggtgaaatgcgtagagatatggaggaacaccagtggcgaaggcgactctctggtctgtaactgacgctgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccatcattcagttgggcactctaaggtgactgccggtgacaaaccggaggaaggtggggatgacgtcaaatcatcatgccccttatgacctgggctacacacgtgctacaatggacggtacaaagagtcgcgagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctatgga

SEQ ID NO: 94 - DNA, 1550 bp, Bacillus deserti
  ref <308>: DATABASE ACCESSION NUMBER: NCBI ACCESSION: NZ_PGUY01000049.1
  ref <309>: DATABASE ENTRY DATE: 2019-04-01
  ref <313>: RELEVANT RESIDUES IN SEQ ID NO: (1)..(1550)
tcggagagtttgatcctggctcaggacgaacgctggcggcgtgcctaatacatgcaagtcgagcggatggaaggaagcttgcttcctaaagtcagcggcggacgggtgagtaacacgtgggcaacctgcccctaagatcgggataacttcgggaaaccggagctaataccggatatgattatgtctcacatgagacgtaatggaaagacggtttcggctgtcacttagggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtaccatagtaactgatggtaccttgacggtacctaaccagaaagccacggctaactacgtgccagcagccgcggtaatacgtaggtggcaagcgttgtccggatttattgggcgtaaagcgcgcgcaggcggtcttttaagtctgatgtgaaagcccacggctcaaccgtggagggtcattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaagccgcgaggccgagccaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 95 - DNA, 1077 bp, Bacillus endophyticus
agttttgaaaagcttgcttttcaaaacttagcggcggacgggtgagtaacacgtgggcaacctgcccttgagacggggataactccgggaaaccggagctaataccggataacacatatcttcgcatgaggatatgttagaaggtggcttttagctaccactcaaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtacctgttgaataagcaggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacggggacccgcacaagcggtggagcatgtggtttaattcgaagcaacgcgaagaaccttaccaggtcttgacatcctctgctacttctagagatagaaggttcccttcggggacagagtgacaggtggtgcatggttgtcgtcagctcgtgtcgtgagatgttgggttaagtcccgcaacgagcgcaacccttgatcttagttgccagcatt

SEQ ID NO: 96 - DNA, 1556 bp, Bacillus firmus
  ref <308>: DATABASE ACCESSION NUMBER: NCBI ACCESSION: NZ_UFTC01000001.1
  ref <309>: DATABASE ENTRY DATE: 2019-04-01
  ref <313>: RELEVANT RESIDUES IN SEQ ID NO: (1)..(1556)
ttatatggagagtttgatcctggctcaggacgaacgctggcggcgtgcctaatacatgcaagtcgagcggacggatgggagcttgctcccagaccgtcagcggcggacgggtgagtaacacgtgggcaacctgcctgtaagactgggataactccgggaaaccggggctaataccggataattcttttcctcacatgaggaaaagctgaaagatggcatctcgctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacaccgcgtgagtgatgaaggttttcggatcgtaaaactctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcattccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgaaaccgtgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 97 - DNA, 1074 bp, Bacillus flexus; identical to SEQ ID NO: 75

SEQ ID NO: 98 - DNA, 1125 bp, Bacillus flexus
  ref <308>: DATABASE ACCESSION NUMBER: NCBI ACCESSION: NZ_QWLS01000157.1
  ref <309>: DATABASE ENTRY DATE: 2019-04-01
  ref <313>: RELEVANT RESIDUES IN SEQ ID NO: (1)..(1125)
ttcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttttcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaaccctt

SEQ ID NO: 99 - DNA, 1555 bp, Bacillus foraminis
  ref <308>: DATABASE ACCESSION NUMBER: NCBI ACCESSION: NZ_CP033044.1
  ref <309>: DATABASE ENTRY DATE: 2019-04-01
  ref <313>: RELEVANT RESIDUES IN SEQ ID NO: (1)..(1555)
tttattggagagtttgatcctggctcaggacgaacgctggcggcgtgcctaatacatgcaagtcgagcgaatcggagggagcttgctcccaaagattagcggcggacgggtgagtaacacgtgggcaacctgcctgtaagactgggataacttcgggaaaccggagctaataccggataatccttttcctcacatgagggaaagctgaaagacggtttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtgccggagtaactgccggcaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatagaacaaagggcagcgaagccgcgaggtgaagccaatcccataaatctattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacctttatggggccagccgcctaaggtgggacagatgattggggtgaagtcgtaacaaggtagccgtatcggaaggtgcggctggatcacctcctttcta

SEQ ID NO: 100 - DNA, 1546 bp, Bacillus fortis
  misc_feature (71)..(71): n is a, c, g, or t
  misc_feature (182)..(182): n is a, c, g, or t
  misc_feature (214)..(214): n is a, c, g, or t
  ref <308>: DATABASE ACCESSION NUMBER: NCBI ACCESSION: NZ_QYTU02000023.1
  ref <309>: DATABASE ENTRY DATE: 2019-04-01
  ref <313>: RELEVANT RESIDUES IN SEQ ID NO: (1)..(1546)
tgagagtttgatcctggctcaggacgaacgctggcggcgtgcctaatacatgcaagtcgagcggatgaagnggagcttgctccttggattcagcggcggacgggtgagtaacacgtgggcaacctgcctgtaagactgggataactccgggaaaccggggctaataccggataacttctttncccgcatggggagaggttgaaagacggttatnctgtcacttacagatgggcccgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggccttcgggtcgtaaaactctgttatcagggaagaacaagcgtcggttaactgccggtgccttgacggtacctgaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtgcagagatgtgcctttcccttcggggacagcggtgacaggtggtgcatggttgtcgtcagctcgtgtcgtgagatgttgggttaagtcccgcaacgagcgcaacccttgatcttagttgccagcattgagttgggcactctaaggtgactgccggtgacaaaccggaggaaggtggggatgacgtcaaatcatcatgccccttatgacctgggctacacacgtgctacaatggatggtacagagggcagcgagaccgcgaggtggagcgaatcccttaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccgtaaggagccagccgccgaaggtgggacagatgattggggtgaagtcgtaacaaggtagccgtatcggaaggtgcggctggatcacctcctttcta

SEQ ID NO: 101 - DNA, 1552 bp, Bacillus freudenreichii
  ref <308>: DATABASE ACCESSION NUMBER: NCBI ACCESSION: NZ_LR134328.1
  ref <309>: DATABASE ENTRY DATE: 2019-04-01
  ref <313>: RELEVANT RESIDUES IN SEQ ID NO: (1)..(1552)
tttatgagagtttgatcctggctcaggacgaacgctggcggcgtgcctaatacatgcaagtcgagcggatgaagaggagcttgctccttggattcagcggcggacgggtgagtaacacgtgggcaacctgcctgtaagactgggataactccgggaaaccggggctaataccggataacttcttttctcgcatgggaagaggttgaaagatggttttgctgtcacttacagatgggcccgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggccttcgggtcgtaaaactctgttatcagggaagaacaagcatcatttaactgatggtgccttgacggtacctgaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagagaacaggattagataccctggtattccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtgcagagatgtgcctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacagagggcagcgagaccgcgaggttcagcgaatcccttaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttctgggagccagccgccgaaggtgggacagatgattggggtgaagtcgtaacaaggtagccgtatcggaaggtgcggctggatcacctcctttcta

SEQ ID NO: 102 - DNA, 1373 bp, Bacillus funiculus
  ref <308>: DATABASE ACCESSION NUMBER: NCBI ACCESSION: NZ_SCFM01000057.1
  ref <309>: DATABASE ENTRY DATE: 2019-04-01
  ref <313>: RELEVANT RESIDUES IN SEQ ID NO: (1)..(1373)
tttcgagcatcgcatgatgcttgatggaaagacggtttcggctgtcacttacagatggacccgcgtcgcattagctagttggtgaggtaatggctcaccaaggcgacgatgcgtagccgacctgagagggtgatcggccacactgggactgagacacggcccagactcctacgggaggcagcagtagggaatcttcggcaatgggcgaaagcctgaccgagcaacgccgcgtgagcgatgaaggccttcgggtcgtaaagctctgttgttaaggaagaacaagtacgagagtaactgctcgtaccttgacggtacttaacgagaaagccacggctaactacgtgccagcagccgcggtaatacgtaggtggcgagcgttatccggaattattgggcgtaaagcgcgcgcaggcggtttcttaagtctgatgtgaaagcccacggctcaaccgtggagggtcattggaaactgggaaacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgaagttaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacggtacaaagagtcgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttacgggagccagccgcctaaggtgggacagatgattggggtgaagtcgtaacaaggtagccgtatcggaaggtgcggctggatcacctcctttct

SEQ ID NO: 103 - DNA, 1555 bp, Bacillus glycinifermentans
  ref <308>: DATABASE ACCESSION NUMBER: NCBI ACCESSION: NZ_LT603683.1
  ref <309>: DATABASE ENTRY DATE: 2019-04-01
  ref <313>: RELEVANT RESIDUES IN SEQ ID NO: (1)..(1555)
ttttatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaatactggatgcttgtttgaaccgcatggttcaaacataaaaggtggcttttcgctaccacttacagatggacccgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaacagggcggtaccttgacggtacctaaccagaaagccacggctaactacgtgccagcagccgcggtaatacgtaggtggcaagcgttgtccggaattattgggcgtaaagcgcgcgcaggcggttctttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 104 - DNA, 1557 bp, Bacillus gobiensis
  ref <308>: DATABASE ACCESSION NUMBER: NCBI ACCESSION: NZ_CP012600.1
  ref <309>: DATABASE ENTRY DATE: 2019-04-01
  ref <313>: RELEVANT RESIDUES IN SEQ ID NO: (1)..(1557)
tttattggagagtttgatcctggctcaggacgaacgctggcggcgtgcctaatacatgcaagtcgagcggacctttggaggcttgcctccgaaaggttagcggcggacgggtgagtaacacgtgggtaacctgcctgtaagatcgggataactccgggaaaccggggctaataccggatgcgtcacgaaaccgcatggttttgtgatcaaaggtggcacttgtgctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgtcagggaagaacacgtgccggttgaataagccggtaccttgacggtacctgaccagaaagccacggctaactacgtgccagcagccgcggtaatacgtaggtggcaagcgttgtccggaattattgggcgtaaagcgcgcgcaggcggttctttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgaccaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggctgcgagaccgcaaggtttagccaatcccacaaatctgttctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtgaggtaaccatttggagccagccgccgaaggtggggcagatgattggggtgaagtcgtaacaaggtagccgtatcggaaggtgcggctggatcacctcctttctaa

SEQ ID NO: 105 - DNA, 1553 bp, Bacillus halotolerans
  ref <308>: DATABASE ACCESSION NUMBER: NCBI ACCESSION: NZ_CP029364.1
  ref <309>: DATABASE ENTRY DATE: 2019-04-01
  ref <313>: RELEVANT RESIDUES IN SEQ ID NO: (1)..(1553)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggttccttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttcta

SEQ ID NO: 106 - DNA, 1508 bp, Bacillus haynesii
  ref <308>: DATABASE ACCESSION NUMBER: NCBI ACCESSION: NZ_MRBL01000076.1
  ref <309>: DATABASE ENTRY DATE: 2019-04-01
  ref <313>: RELEVANT RESIDUES IN SEQ ID NO: (1)..(1508)
agagtttgatcctggctcaggacgaacgctggcggcgtgcctaatacatgcaagtcgagcggaccgacgggagcttgctcccttaggttagcggcggacgggtgagtaacacgtgggtaacctgcctgtaagactgggataactccgggaaaccggggctaataccggatgcttgattgaaccgcatggttcaattataaaaggtggcttttagctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggta

SEQ ID NO: 107 - DNA, 1556 bp, Bacillus hisashii
  ref <308>: DATABASE ACCESSION NUMBER: NCBI ACCESSION: NZ_NJGA01000140.1
  ref <309>: DATABASE ENTRY DATE: 2019-04-01
  ref <313>: RELEVANT RESIDUES IN SEQ ID NO: (1)..(1556)
ttttttggagagtttgatcctggctcaggacgaacgctggcggcgtgcctaatacatgcaagtcgagcgaaccaataagaagcttgctttttgttggttagcggcggacgggtgagtaacacgtgggtaacctgcctgtaagaccgggataactccgggaaaccggtgctaataccggatagattatctttccgcctggagagataaggaaagatggcttttgccatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtatcggaggaaatgccggtaccttgacggtacctgacgagaaagccacggctaactacgtgccagcagccgcggtaatacgtaggtggcaagcgttgtccggaattattgggcgtaaagcgcgcgcaggcggtcctttaagtctgatgtgaaatcttgcggctcaaccgcaagcggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatctcctgaccgccctggagacagggtcttcccttcggggacaggatgacaggtggtgcatggttgtcgtcagctcgtgtcgtgagatgttgggttaagtcccgcaacgagcgcaacccttggttctagttgccagcattcagttgggcactctagagcgactgccggcgacaagtcggaggaaggtggggatgacgtcaaatcatcatgccccttatgacctgggctacacacgtgctacaatggatggtacaaagggcagcgaagcggcgacgcatgagcgaatcccagaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccgtaaggagccagccgccgaaggtgggacagatgattggggtgaagtcgtaacaaggtagccgtatcggaaggtgcggctggatcacctcctttctaa

SEQ ID NO: 108 - DNA, 1558 bp, Bacillus horikoshii
  ref <308>: DATABASE ACCESSION NUMBER: NCBI ACCESSION: NZ_CP020880.1
  ref <309>: DATABASE ENTRY DATE: 2019-04-01
  ref <313>: RELEVANT RESIDUES IN SEQ ID NO: (1)..(1558)
ctttattggagagtttgatcctggctcaggacgaacgctggcggcgtgcctaatacatgcaagtcgagcggaccttttaaaagcttgcttttgaaaggtcagcggcggacgggtgagtaacacgtgggcaacctgcctgtaagactgggataacttcgggaaaccggagctaataccggataatataaggaacctcctggttctttattgaaagatggtttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggtggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagcaaaaccgcgaggtcgagccaatcccataaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 109 - DNA, 1555 bp, Bacillus horneckiae
  ref <308>: DATABASE ACCESSION NUMBER: NCBI ACCESSION: NZ_PISD01000045.1
  ref <309>: DATABASE ENTRY DATE: 2019-04-01
  ref <313>: RELEVANT RESIDUES IN SEQ ID NO: (1)..(1555)
tttattggagagtttgatcctggctcaggacgaacgctggcggcgtgcctaatacatgcaagtcgagcgaatctgagggagcttgctcccaaagattagcggcggacgggtgagtaacacgtgggcaacctgcctgtaagactgggataacttcgggaaaccggagctaataccggataatccctttcctcacatgaggaaaggctgaaagacggcgtctagctgtcacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcgaacaggattagataccctggtagtccacgccgtaaacgatgagtgctaagtgttagagggtttccgccctttagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctctgacaatcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 110 - DNA, 1539 bp, Bacillus indicus
  ref <308>: DATABASE ACCESSION NUMBER: NCBI ACCESSION: NZ_JNVC02000019.1
  ref <309>: DATABASE ENTRY DATE: 2019-04-01
  ref <313>: RELEVANT RESIDUES IN SEQ ID NO: (1)..(1539)
tcggagagtttgatcctggctcaggacgaacgctggcggcgtgcctaatacatgcaagtcgagcggatctcttcggagatcagcggcggacgggtgagtaacacgtgggcaacctgcctgtaagactgggataactccgggaaaccggagctaataccggatactatgtcaaaccgcatggtttgacattcaaagacggtttcggctgtcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgtcggagtaactgccggcaccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctttgccacttctagagatagaaggttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaaccgcaaggagccagccgcctaaggtggggtagatgattggggtgaagtcgtaacaaggtagccgtatcggaaggtgcggctggatcacctcctttctaa

SEQ ID NO: 111 - DNA, 1138 bp, Bacillus infantis
  ref <308>: DATABASE ACCESSION NUMBER: NCBI ACCESSION: NZ_SEHK01000032.1
  ref <309>: DATABASE ENTRY DATE: 2019-04-01
  ref <313>: RELEVANT RESIDUES IN SEQ ID NO: (1)..(1138)
gatgaaggttttcggatcgtaaaactctgttgtcagggaagaacaagtgccggagtaactgccggcaccttgacggtacctgaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 112 - DNA, 1553 bp, Bacillus intestinalis
  ref <308>: DATABASE ACCESSION NUMBER: NCBI ACCESSION: NZ_NKAK01000016.1
  ref <309>: DATABASE ENTRY DATE: 2019-04-01
  ref <313>: RELEVANT RESIDUES IN SEQ ID NO: (1)..(1553)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 113 - DNA, 1554 bp, Bacillus kochii
  ref <308>: DATABASE ACCESSION NUMBER: NCBI ACCESSION: NZ_CP022983.1
  ref <309>: DATABASE ENTRY DATE: 2019-04-01
  ref <313>: RELEVANT RESIDUES IN SEQ ID NO: (1)..(1554)
tttattggagagtttgatcctggctcaggacgaacgctggcggcgtgcctaatacatgcaagtcgagcgaatctgagggagcttgctcccaaagattagcggcggacgggtgagtaacacgtgggcaacctgcctgtaagactgggataactccgggaaaccggggctaataccggataatatctatttatacatataattagattgaaagatggttctgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctctgacaatcctagagataggactttccccttcggggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 114 - DNA, 1552 bp, Bacillus kwashiorkori
  ref <308>: DATABASE ACCESSION NUMBER: NCBI ACCESSION: NZ_CTDX01000006.1
  ref <309>: DATABASE ENTRY DATE: 2019-04-01
  ref <313>: RELEVANT RESIDUES IN SEQ ID NO: (1)..(1552)
tttttggagagtttgatcctggctcaggacgaacgctggcggcgtgcctaatacatgcaagtcgagcgaaccaataaaacttcggttttactggttagcggcggacgggtgagtaacacgtgggcaacctgcctgtaagactgggataactcacggaaacgtgggctaataccggatagttttttctcttgcataagagaaaaaggaaaggaggcgcaagcttccacttacagatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggtcttcggatcgtaaaactctgttgcaagggaagaacaagtaccgtttgaataaggcggtaccttgacggtacctggcgagaaagccacggctaactacgtgccagcagccgcggtaatacgtaggtggcaagcgttgtccggaattattgggcgtaaagcgcgcgcaggcggtcctttaagtctgatgtgaaatcttgcggctcaaccgcaagcggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatctcctgaaacccctagagatagggttttcccttcggggacaggatgacaggtggtgcatggttgtcgtcagctcgtgtcgtgagatgttgggttaagtcccgcaacgagcgcaacccttgagattagttgccagcattcagttgggcactctaatctgactgccggtgacaagccggaggaaggtggggatgacgtcaaatcatcatgccccttatgacctgggctacacacgtgctacaatggacggtacagagggcagcgaagctgtgaagtggagctaatcccaaaaaaccgttctcagttcggattgtaggctgcaactcgcctacatgaagccggaatcgctagtaatcgcagatcagcatgctgcggtgaatacgttcccgggccttgtacacaccgcccgtcacaccacgagagtttgtaacacccgaagtcggtggggtaaccatttggagccagccgccgaaggtgggacagatgattggggtgaagtcgtaacaaggtagccgtatcggaaggtgcggctggatcacctcctttcta

SEQ ID NO: 115 - DNA, 1555 bp, Bacillus lentus
  ref <308>: DATABASE ACCESSION NUMBER: NCBI ACCESSION: NZ_LS483476.1
  ref <309>: DATABASE ENTRY DATE: 2019-04-01
  ref <313>: RELEVANT RESIDUES IN SEQ ID NO: (1)..(1555)
tttaacgagagtttgatcctggctcaggacgaacgctggcggcgtgcctaatacatgcaagtcgagcgaatggatgggagcttgctcccggaagttagcggcggacgggtgagtaacacgtgggcaacctacctgtaagactgggataacttcgggaaaccggagctaataccggataacttctttcttctcctggagaaaggttgaaagacggcttcggctgttacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttatcagggaagaacaagtatcggagtaactgccggtaccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggaaggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagagggtttccgccctttagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaccaccctagagatagggacttccccttcgggggacagagtgacaggtggtgcatggttgtcgtcagctcgtgtcgtgagatgttgggttaagtcccgcaacgagcgcaacccttaaccttagttgccagcattcagttgggcactctaaggtgactgccggtgacaaaccggaggaaggtggggatgacgtcaaatcatcatgccccttatgacctgggctacacacgtgctacaatggatggtacaaagggttgcaagaccgcgaggtttagctaatcccataaaaccattctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 116 - DNA, 1552 bp, Bacillus licheniformis
  ref <308>: DATABASE ACCESSION NUMBER: NCBI ACCESSION: NZ_LR134165.1
  ref <309>: DATABASE ENTRY DATE: 2019-04-01
  ref <313>: RELEVANT RESIDUES IN SEQ ID NO: (1)..(1552)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgattgaaccgcatggttcaattataaaaggtggcttttagctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttct

SEQ ID NO: 117 - DNA, 1555 bp, Bacillus litoralis
  ref <308>: DATABASE ACCESSION NUMBER: NCBI ACCESSION: NZ_CP033043.1
  ref <309>: DATABASE ENTRY DATE: 2019-04-01
  ref <313>: RELEVANT RESIDUES IN SEQ ID NO: (1)..(1555)
tttattggagagtttgatcctggctcaggacgaacgctggcggcgtgcctaatacatgcaagtcgagcgaatcaatgggagcttgctccctgagattagcggcggacgggtgagtaacacgtgggtaacctgcctgtaagattgggataactccgggaaaccggagctaataccggataatattttgaaccgcatggtttgaaattgaaagacggcttttagctgtcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgctcgcaggcggtttcttaagtctgatgtgaaagcccacggctcaaccgtggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatccttcgctacttctagagatagtaggttccccttttaggggacgaagtgacaggtggtgcatggttgtcgtcagctcgtgtcgtgagatgttgggttaagtcccgcaacgagcgcaacccttgatcttagttgccagcattaggttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttct

SEQ ID NO: 118 - DNA, 1553 bp, Bacillus lonarensis
  ref <308>: DATABASE ACCESSION NUMBER: NCBI ACCESSION: NZ_FMYM01000017.1
  ref <309>: DATABASE ENTRY DATE: 2019-04-01
  ref <313>: RELEVANT RESIDUES IN SEQ ID NO: (1)..(1553)
tttaatggagagtttgatcctggctcaggacgaacgctggcggcgtgcctaatacatgcaagtcgagcgcacagaagggagcttgctcccggaagtgagcggcggacgggtgagtaacacgtgggcaacctgccccctagcctgggataacttcgggaaaccgaagctaataccggataacatattgacctacctaggtcgatattaaaagatggcttctgctatcactaagggatgggcccgcggcgcattagctagttggtgaggtaacagctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgtgagggaagaacaagtaccgtttgaataaggcggtaccgtgacggtacctcaccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaagcggccattggaaactgggaagcttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagtaaacacattaagcactccgcctggggagtacgaccgcaaggttgaaactcaaaggaattgacggggacccgcacaagcagtggagcatgtggtttaattcgaagcaacgcgaagaaccttaccaggtcttgacatcctttgaccaccctagagatagggctttcccttcggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggacgacgtcaaatcatcatgccccttatgacctgggctacacacgtgctacaatggatggtacaaagggaagcgaaaccgcgaggtggagccaatcccataaagccattctcagttcggattgtaggctgcaactcgcctacatgaagccggaattgctagtaatcgcggatcagcatgccgcggtgaatacgttcccgggtcttgtacacaccgcccgtcacaccacgagagtttgtaacacccgaagtcggtgagggaaccttttggacccagccgcctaaggtgggacagatgattggggtgaagtcgtaacaaggtagccgtatcggaaggtgcggctggatcacctcctttcta

SEQ ID NO: 119 - DNA, 1553 bp, Bacillus luciferensis
  ref <308>: DATABASE ACCESSION NUMBER: NCBI ACCESSION: NZ_NCTA01000001.1
  ref <309>: DATABASE ENTRY DATE: 2019-04-01
  ref <313>: RELEVANT RESIDUES IN SEQ ID NO: (1)..(1553)
ttttatggagagtttgatcctggctcaggacgaacgctggcggcgtgcctaatacatgcaagtcgagcggactaattggagcttgctccaattagttagcggcggacgggtgagtaacacgtgggcaacctacctataagactgggataacttcgggaaaccggagctaataccggatgacacaaaggaactcctgttcctttgttgaaagatggcttcggctatcacttatagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgctagttgaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgtggatgccttggcactaggagtcgatgaaggacgggactaacaccgatatgcttcggggagctgtaagtaagcggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttct

SEQ ID NO: 120 - DNA, 1556 bp, Bacillus luti
  ref <308>: DATABASE ACCESSION NUMBER: NCBI ACCESSION: NZ_MACI01000041.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 121 - DNA, 1567 bp, Bacillus marinisedimentorum
  ref <308>: DATABASE ACCESSION NUMBER: NCBI ACCESSION: NZ_LWBL02000085.1
  ref <309>: DATABASE ENTRY DATE: 2019-04-01
  ref <313>: RELEVANT RESIDUES IN SEQ ID NO: (1)..(1567)
tttatcggagagtttgatcctggctcaggacgaacgctggcggcgtgcctaatacatgcaagtcgagcgcgtgaacctggctgatcccttcggggtgacgccagcggatcgagcggcggacgggtgagtaacacgtgggcaacctgcctgtaagatcgggataactccgggaaaccggtgctaataccggatatccatcgggatcgcatgatcctgatgagaaagatggctccggctatcacttacagatgggcccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacacgtgccgtttgaataaggcggcaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagggggtttccgccccttagtgctgaagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctctgacaaccctggagacagggcgtccccttcgggggcagagtgacaggtggtgcatggttgtcgtcagctcgtgtcgtgagatgttgggttaagtcccgcaacgagcgcaacccttgtccttagttgccagcattgagttgggcactctaaggagactgccggtgacaaaccggaggaaggtggggatgacgtcaaatcatcatgccccttatgacctgggctacacacgtgctacaatggatggaacaaagggcagcgagaccgcgaggtcaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagcttgtaacacccgaagtcggtggggtaaccttttggagccagccgcctaaggtgggacaagtgattggggtgaagtcgtaacaaggtagccgtatcggaaggtgcggctggatcacctcctttcta

SEQ ID NO: 122 - DNA, 1550 bp, Bacillus massiliglaciei
  ref <308>: DATABASE ACCESSION NUMBER: NCBI ACCESSION: NZ_LT622343.1
  ref <309>: DATABASE ENTRY DATE: 2019-04-01
  ref <313>: RELEVANT RESIDUES IN SEQ ID NO: (1)..(1550)
tcggagagtttgatcctggctcaggacgaacgctggcggcgtgcctaatacatgcaagtcgagcgaatcaaagggagcttgctcccggagattagcggcggacgggtgagtaacacgtgggcaacctgcctgtaagactgggataacttcgggaaaccggagctaataccggatagtttcttccctctcatgagggaagatggaaagacggtcttggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgtcagggaagaacaagtgccagagtaactgctggcaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagagcagcaaacccgcgagggcaagcaaatctcataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 123 - DNA, 1369 bp, Bacillus massilioanorexius
  ref <308>: DATABASE ACCESSION NUMBER: NCBI ACCESSION: NZ_CAPG01000101.1
  ref <309>: DATABASE ENTRY DATE: 2019-04-01
  ref <313>: RELEVANT RESIDUES IN SEQ ID NO: (1)..(1369)
ctcctacatggagaaaaggggaaagatggtttcggctatcacttatagatgggcccgcggcgcattagctagttggtagggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggaaggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggtttagccaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttctaa

SEQ ID NO: 124 - DNA, 1555 bp, Bacillus massiliogabonensis
  ref <308>: DATABASE ACCESSION NUMBER: NCBI ACCESSION: NZ_LT904903.1
  ref <309>: DATABASE ENTRY DATE: 2019-04-01
  ref <313>: RELEVANT RESIDUES IN SEQ ID NO: (1)..(1555)
tttattggagagtttgatcctggctcaggacgaacgctggcggcgtgcctaatacatgcaagtcgagcgaacttgcgggagcttgctcccaaaagttagcggcggacgggtgagtaacacgtgggcaacctgcctgtaagactgggataacttcgggaaaccggagctaataccggataattcttttcctcacatgtggaaaagctgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctagagataggactttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttcta

SEQ ID NO: 125 - DNA, 1556 bp, Bacillus massilionigeriensis
  ref <308>: DATABASE ACCESSION NUMBER: NCBI ACCESSION: NZ_LT630337.1
  ref <309>: DATABASE ENTRY DATE: 2019-04-01
  ref <313>: RELEVANT RESIDUES IN SEQ ID NO: (1)..(1556)
tttttcggagagtttgatcctggctcaggacgaacgctggcggcgtgcctaatacatgcaagtcgagcgaatctgagggagcttgctcccgatgattagcggcggacgggtgagtaacacgtgggcaacctgcctgtaagactgggataacaccgggaaaccggtgctaataccggataattcttttctactcatgtagaaaagctgaaagatggcctcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggattttccccttcgggggacagagtgacaggtggtgcatggttgtcgtcagctcgtgtcgtgagatgttgggttaagtcccgcaacgagcgcaacccttgagattagttgccagcattgagttgggcactctaatctgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgcaaggggccagccgcctaaggtgggacagatgattggggtgaagtcgtaacaaggtagccgtatcggaaggtgcggctggatcacctcctttctaa

SEQ ID NO: 126 - DNA, 1460 bp, Bacillus massiliosenegalensis
  ref <308>: DATABASE ACCESSION NUMBER: NCBI ACCESSION: NZ_HE978527.1
  ref <309>: DATABASE ENTRY DATE: 2019-04-01
  ref <313>: RELEVANT RESIDUES IN SEQ ID NO: (1)..(1460)
ctttattggagagtttgatcctggctcaggacgaacgctggcggcgtgcctaatacatgcaagtcgagcggatctgagggagcttgctcccaaagattagcggcggacgggtgagtaacacgtgggcaacctgcctataagactgggataacttcgggaaaccggagctaataccggataatgcttttggacacatgtccggaagctgaaagatggcttctcgctatcacttatagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttctttaagtctgatgtgaaagcccccggctcaaccggggagggtcattggaaactggggaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttatgccatccctagagatagggctttcccttcggggacataagtgacaggtggtgcatggttgtcgtcagctcgtgtcgtgagatgttgggttaagtcccgcaacgagcgcaacccttgatcttagttgccagcattgagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagcgaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacc

SEQ ID NO: 127 - DNA, 1553 bp, Bacillus mediterraneensis
  ref <308>: DATABASE ACCESSION NUMBER: NCBI ACCESSION: NZ_LT630004.1
  ref <309>: DATABASE ENTRY DATE: 2019-04-01
  ref <313>: RELEVANT RESIDUES IN SEQ ID NO: (1)..(1553)
tttatggagagtttgatcctggctcaggacgaacgctggcggcgtgcctaatacatgcaagtcgagcggacagaagggagcttgctcccggaagtcagcggcggacgggtgagtaacacgtgggcaacctgcctgtaagactgggataacttcgggaaaccggagctaataccggataatcctttccttcacatgaagggaagctgaaagacggtttcggctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtatcggagtaactgccggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatagaacaaagggcagcgaagccgcgaggtgaagccaatcccataaatctattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 128 - DNA, 1551 bp, Bacillus megaterium
  ref <308>: DATABASE ACCESSION NUMBER: NCBI ACCESSION: NZ_UFSS01000002.1
  ref <309>: DATABASE ENTRY DATE: 2019-04-01
  ref <313>: RELEVANT RESIDUES IN SEQ ID NO: (1)..(1551)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttct

SEQ ID NO: 129 - DNA, 1144 bp, Bacillus megaterium
ttcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggccacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatt

SEQ ID NO: 130 - DNA, 1553 bp, Bacillus mesonae
  ref <308>: DATABASE ACCESSION NUMBER: NCBI ACCESSION: NZ_CP022572.1
  ref <309>: DATABASE ENTRY DATE: 2019-04-01
  ref <313>: RELEVANT RESIDUES IN SEQ ID NO: (1)..(1553)
ttcttggagagtttgatcctggctcaggacgaacgctggcggcgtgcctaatacatgcaagtcgagcgaacttgcgggagcttgctcccaaaagttagcggcggacgggtgagtaacacgtgggcaacctgcctgtaagactgggataacttcgggaaaccggagctaataccggataattcttatcaacacatgttgataagctgaaagtcggtttcggctgacacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggactttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcaaggtctagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttct

SEQ ID NO: 131 - DNA, 1555 bp, Bacillus mobilis
  ref <308>: DATABASE ACCESSION NUMBER: NCBI ACCESSION: NZ_CP031443.1
  ref <309>: DATABASE ENTRY DATE: 2019-04-01
  ref <313>: RELEVANT RESIDUES IN SEQ ID NO: (1)..(1555)
tttattggagagtttgatcctggctcaggatgaacgctggcggcgtgcctaatacatgcaagtcgagcgaatggattgagagcttgctctcgagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttct

SEQ ID NO: 132 - DNA, 1377 bp, Bacillus mycoides
  ref <308>: DATABASE ACCESSION NUMBER: NCBI ACCESSION: NZ_FMJH01000033.1
  ref <309>: DATABASE ENTRY DATE: 2019-04-01
  ref <313>: RELEVANT RESIDUES IN SEQ ID NO: (1)..(1377)
attttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaactctagagatagagcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttctatgga

SEQ ID NO: 133 - DNA, 1554 bp, Bacillus nealsonii
  ref <308>: DATABASE ACCESSION NUMBER: NCBI ACCESSION: NZ_PISE01000038.1
  ref <309>: DATABASE ENTRY DATE: 2019-04-01
  ref <313>: RELEVANT RESIDUES IN SEQ ID NO: (1)..(1554)
tttattggagagtttgatcctggctcaggacgaacgctggcggcgtgcctaatacatgcaagtcgagcggacttaaaaagcttgctttttaagttagcggcggacgggtgagtaacacgtgggcaacctgcctgtaagactgggataacttcgggaaaccggagctaataccggataatccttttctactcatgtagagaagtctgaaagacggcatctcgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggatagatgattggggtgaagtcgtaacaaggtagccgtatcggaaggtgcggctggatcacctcctttct

SEQ ID NO: 134 - DNA, 1030 bp, Bacillus nitratireducens
  ref <308>: DATABASE ACCESSION NUMBER: NCBI ACCESSION: NZ_MAOC01000001.1
  ref <309>: DATABASE ENTRY DATE: 2019-04-01
  ref <313>: RELEVANT RESIDUES IN SEQ ID NO: (1)..(1030)
tttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaactctagagatag

SEQ ID NO: 135 - DNA, 1259 bp, Bacillus notoginsengisoli
  ref <308>: DATABASE ACCESSION NUMBER: NCBI ACCESSION: NZ_QWEG01000045.1
  ref <309>: DATABASE ENTRY DATE: 2019-04-01
  ref <313>: RELEVANT RESIDUES IN SEQ ID NO: (1)..(1259)
agctgaaagacggtttcggctgtcacttacagatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtgccggagtcactgccggcaccttgacggtacctgaccagaaagccacggctaactacgtgccagcagccgcggtaatacgtaggtggcaagcgttgtccggaattattgggcgtaaagcgcgcgcaggcggcctcttaagtctgatgtgaaagcccacggctcaaccgtggagggtcattggaaactggggggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacacctctggagacagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgggagtttgtaacacccgaagtcggtggggtaaccttt

SEQ ID NO: 136 - DNA, 1554 bp, Bacillus oceanisediminis
  ref <308>: DATABASE ACCESSION NUMBER: NCBI ACCESSION: NZ_QGTW01000037.1
  ref <309>: DATABASE ENTRY DATE: 2019-04-01
  ref <313>: RELEVANT RESIDUES IN SEQ ID NO: (1)..(1554)
ttatatggagagtttgatcctggctcaggacgaacgctggcggcgtgcctaatacatgcaagtcgagcggacggatgggagcttgctccctgaagtcagcggcggacgggtgagtaacacgtgggcaacctgcctgtaagactgggataacttcgggaaaccggagctaataccggataattctttccctcacatgagggaaagctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 137 - DNA, 1312 bp, Bacillus oleivorans
  ref <308>: DATABASE ACCESSION NUMBER: NCBI ACCESSION: NZ_OAOP01000021.1
  ref <309>: DATABASE ENTRY DATE: 2019-04-01
  ref <313>: RELEVANT RESIDUES IN SEQ ID NO: (1)..(1312)
cgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggagacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttcgctacctctagagatagagggttcccttcggggacgaagtgacaggtggtgcatggttgtcgtcagctcgtgtcgtgagatgttgggttaagtcccgcaacgagcgcaacccttgaccttagttgccagcattaagttgggcactctaaggtgactgccggtgacaaaccggaggaaggtggggatgacgtcaaatcatcatgccccttatgacctgggctacacacgtgctacaatggatagaacaaagggcagcaaagccgcgaggccgagccaatcccacaaatctattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgccgaaggtgggacagatgattggggtgaagtcgtaacaaggtagccgtatcggaaggtgcggctggatcacctcctttcta

SEQ ID NO: 138 - DNA, 1558 bp, Bacillus onubensis
  ref <308>: DATABASE ACCESSION NUMBER: NCBI ACCESSION: NZ_NSEA01000017.1
  ref <309>: DATABASE ENTRY DATE: 2019-04-01
  ref <313>: RELEVANT RESIDUES IN SEQ ID NO: (1)..(1558)
tcttattggagagtttgatcctggctcaggatgaacgctggcggcgtgcctaatacatgcaagtcgagcgaacttttgggagcttgctcccaaaagttagcggcggacgggtgagtaacacgtgggcaacctgcctataagactgggataacttcgggaaaccggagctaataccggataacatatgagaccacatggtctcatattaaaagatggcttttagctatcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtaccgttcaaatagggcggtaccttgacggtacctaaccagaaagccacggctaactacgtgccagcagccgcggtaatacgtaggtggcaagcgttatccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgtgacaactctagagatagggctttccccttcgggggacacggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggttaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 139 - DNA, 1554 bp, Bacillus pacificus
  ref <308>: DATABASE ACCESSION NUMBER: NCBI ACCESSION: NZ_RQST01000032.1
  ref <309>: DATABASE ENTRY DATE: 2019-04-01
  ref <313>: RELEVANT RESIDUES IN SEQ ID NO: (1)..(1554)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattcagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttct

SEQ ID NO: 140 - DNA, 1552 bp, Bacillus paralicheniformis
  ref <308>: DATABASE ACCESSION NUMBER: NCBI ACCESSION: NZ_CP033389.1
  ref <309>: DATABASE ENTRY DATE: 2019-04-01
  ref <313>: RELEVANT RESIDUES IN SEQ ID NO: (1)..(1552)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgattgaaccgcatggttcaattataaaaggtggcttttagctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttct

SEQ ID NO: 141 - DNA, 1555 bp, Bacillus paramycoides
  ref <308>: DATABASE ACCESSION NUMBER: NCBI ACCESSION: NZ_MAOI01000012.1
  ref <309>: DATABASE ENTRY DATE: 2019-04-01
  ref <313>: RELEVANT RESIDUES IN SEQ ID NO: (1)..(1555)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttct

SEQ ID NO: 142 - DNA, 1532 bp, Bacillus paranthracis
  ref <308>: DATABASE ACCESSION NUMBER: NCBI ACCESSION: NZ_MACE01000012.1
  ref <309>: DATABASE ENTRY DATE: 2019-04-01
  ref <313>: RELEVANT RESIDUES IN SEQ ID NO: (1)..(1532)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaagg

SEQ ID NO: 143 - DNA, 640 bp, Bacillus persicus
  ref <308>: DATABASE ACCESSION NUMBER: NCBI ACCESSION: NZ_FOBW01000035.1
  ref <309>: DATABASE ENTRY DATE: 2019-04-01
  ref <313>: RELEVANT RESIDUES IN SEQ ID NO: (1)..(640)
ctttattggagagtttgatcctggctcaggacgaacgctggcggcgtgcctaatacatgcaagtcgagcggactgatgggagcttgctccctgatgttagcggcggacgggtgagtaacacgtgggcaacctgcctgtaagactgggataactccgggaaaccggggctaataccggataattcttgtcctcccatgaggacaagctgaaagacggttacggctgtcacttacagatgggcccgcggcgcattagctagttggtgaggtaatggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaatgagtatcggattaactgccggtaccttgccggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggaggg

SEQ ID NO: 144 - DNA, 1567 bp, Bacillus populi
  ref <308>: DATABASE ACCESSION NUMBER: NCBI ACCESSION: NZ_KZ293963.1
  ref <309>: DATABASE ENTRY DATE: 2019-04-01
  ref <313>: RELEVANT RESIDUES IN SEQ ID NO: (1)..(1567)
tacggagagtttgatcctggctcaggacgaacgctggcggcgtgcctaatacatgcaagtcgagcgcgggaagcaagtggatcccttcggggtgaaacttgtggaacgagcggcggacgggtgagtaacacgtgggcaacctgcctcacagactgggataactccgggaaaccggggctaataccggatgatcaaagggatcgcatgattcttttgtaaaagttgggttttacctaacactgtgagatgggcccgcggcgcattagctagttggtgaggtagtggctcaccaaggcgacgatgcgtagccgacctgagagggtgatcggccacactgggactgagacacggcccagactcctacgggaggcagcagtagggaatcatccgcaatgggcgaaagcctgacggtgcaacgccgcgtgagtgatgacggtcttcggattgtaaagctctgttgttagggaagaacaagtgccgtgcgaatagaacggcaccttgacggtacctaaccagaaagccccggctaactacgtgccagcagccgcggtaatacgtagggggcaagcgttgtccggaattattgggcgtaaagcgcgcgcaggcggttctttaagtctgatgtgaaagcccacggctcaaccgtggagggtcattggaaactggggaacttgagtgtaggagaggaaagtggaattccaagtgtagcggtgaaatgcgtagatatttggaggaacaccagtggcgaaggcgactttctggcctacaactgacgctgaggcgcgaaagcgtggggagcaaacaggattagataccctggtagtccacgccgtaaacgatgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgacacccttagagataaggctttccccttcgggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggcagcaaagccgcgaggccgagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagcttgtaacacccgaagtcggtgcggtaaccttttggagccagccgccgaaggtgggacaggtgattggggtgaagtcgtaacaaggtatccctaccggaaggtggggatggatcacctcctttcta

SEQ ID NO: 145 - DNA, 1217 bp, Bacillus praedii
  ref <308>: DATABASE ACCESSION NUMBER: NCBI ACCESSION: NZ_LMBX01000060.1
  ref <309>: DATABASE ENTRY DATE: 2019-04-01
  ref <313>: RELEVANT RESIDUES IN SEQ ID NO: (1)..(1217)
agatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccccggctcaaccggggagggtcattggaaactgggagacttgagtgcagaagaggaaagtggaattccaagtgtagcggtgaaatgcgtagagatttggaggaacaccagtggcgaaggcgactttctggtctgtaactgacactgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcgg

SEQ ID NO: 146 - DNA, 1556 bp, Bacillus proteolyticus
  ref <308>: DATABASE ACCESSION NUMBER: NCBI ACCESSION: NZ_MACH01000033.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 147 - DNA, 1556 bp, Bacillus pseudomycoides
  ref <308>: DATABASE ACCESSION NUMBER: NCBI ACCESSION: NZ_NUUH01000126.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgcaccgcatggtgcgaaattcaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 148 - DNA, 1487 bp, Bacillus pumilus
  ref <308>: DATABASE ACCESSION NUMBER: NCBI ACCESSION: NZ_UWJF01000021.1
  ref <309>: DATABASE ENTRY DATE: 2019-04-01
  ref <313>: RELEVANT RESIDUES IN SEQ ID NO: (1)..(1487)
gcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttcta

SEQ ID NO: 149 - DNA, 903 bp, Bacillus safensis
cactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatga

SEQ ID NO: 150 - DNA, 1174 bp, Bacillus safensis
  ref <308>: DATABASE ACCESSION NUMBER: NCBI ACCESSION: NZ_RYXI01000009.1
  ref <309>: DATABASE ENTRY DATE: 2019-04-01
  ref <313>: RELEVANT RESIDUES IN SEQ ID NO: (1)..(1174)
acgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaaccttt

SEQ ID NO: 151 - DNA, 532 bp, Bacillus salarius
  ref <308>: DATABASE ACCESSION NUMBER: NCBI ACCESSION: NZ_RBVX01000215.1
  ref <309>: DATABASE ENTRY DATE: 2019-04-01
  ref <313>: RELEVANT RESIDUES IN SEQ ID NO: (1)..(532)
tgacggtaccggatcagaaagccccggctaactacgtgccagcagccgcggtaatacgtagggggcaagcgttgtccggaattattgggcgtaaagggcgcgcaggcggtttcctaagtctgatgtgaaaggccacggctcaaccgtggaatggcattggaaactggggaacttgagtacaggagaggagagtggaattccacgtgtagcggtgaaatgcgtagagatgtggaggaacaccagtggcgaaggcggctctctggcctgtaactgacgctgaggcgcgaaagcgtggggagcgaacaggattagataccctggtagtccacgccgtaaacgttgagtgctaggtgttaggggtttcgacacccttagtgccgaagcaaacgcattaagcactccgcctggggagtacgaccgcaaggttgaaactcaaaggaattgacgggggcccgcacaagcggtggagcatgtggtttaattcgacgcaacgcgaagaaccttaccaggtcttgacatcttttgctacttc

SEQ ID NO: 152 - DNA, 1462 bp, Bacillus salsus
  ref <308>: DATABASE ACCESSION NUMBER: NCBI ACCESSION: NZ_FNJU01000032.1
  ref <309>: DATABASE ENTRY DATE: 2019-04-01
  ref <313>: RELEVANT RESIDUES IN SEQ ID NO: (1)..(1462)
attagcggcggacgggtgagtaacacgtgggcaatctgcctgtaagactgggataacttcgggaaaccggagctaataccggataatatagagaaccgcatggttctctattaaaagatggtttcggctatcacttacagatgagcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttaaggaagaacaagtacgagagtaactgctcgtaccttgacggtacttaaccagaaagccacggctaactacgtgccagcagccgcggtaatacgtaggtggcaagcgttatccggaattattgggcgtaaaggcgctcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccaatgacctccctagagatagggctttaccttcgggtacattggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggttaagcgaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 153 - DNA, 1554 bp, Bacillus siamensis
  ref <308>: DATABASE ACCESSION NUMBER: NCBI ACCESSION: NZ_CP025001.1
  ref <309>: DATABASE ENTRY DATE: 2019-04-01
  ref <313>: RELEVANT RESIDUES IN SEQ ID NO: (1)..(1554)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttcta

SEQ ID NO: 154 - DNA, 1556 bp, Bacillus soli
  ref <308>: DATABASE ACCESSION NUMBER: NCBI ACCESSION: NZ_NISV01000001.1
  ref <309>: DATABASE ENTRY DATE: 2019-04-01
  ref <313>: RELEVANT RESIDUES IN SEQ ID NO: (1)..(1556)
tttcttggagagtttgatcctggctcaggacgaacgctggcggcgtgcctaatacatgcaagtcgagcgaatctttgggagcttgctcccattggttagcggcggacgggtgagtaacacgtgggcaacctgcctgtaagactgggataacttcgggaaaccggagctaataccggataattcttttcctctcatgaggagaagctgaaagtcggtttcggctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcgaggttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttctaa

SEQ ID NO: 155 - DNA, 1556 bp, Bacillus sp. 100374
  ref <308>: DATABASE ACCESSION NUMBER: NCBI ACCESSION: NZ_NWUW01000108.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattcagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 156 - DNA, 249 bp, Bacillus sp. 103mf
  ref <308>: DATABASE ACCESSION NUMBER: NCBI ACCESSION: NZ_FPAF01000028.1
  ref <309>: DATABASE ENTRY DATE: 2019-04-01
  ref <313>: RELEVANT RESIDUES IN SEQ ID NO: (1)..(249)
tttattggagagtttgatcctggctcaggatgaacgctggcggcgtgcctaatacatgcaagtcgagcgaaccgattaagagcttgctcttaagaagttagcggcggacgggtgagtaacacgtaggtaacctgcctataagactgggataactccgggaaaccggggctaataccggataacattttgcaccgcatggtgcaaaattgaaaggcggcttcggctgtcacttatagatggacctgcggc

SEQ ID NO: 157 - DNA, 459 bp, Bacillus sp. 112mf
  ref <308>: DATABASE ACCESSION NUMBER: NCBI ACCESSION: NZ_FNRB01000004.1
  ref <309>: DATABASE ENTRY DATE: 2019-04-01
  ref <313>: RELEVANT RESIDUES IN SEQ ID NO: (1)..(459)
tttattggagagtttgatcctggctcaggatgaacgctggcggcgtgcctaatacatgcaagtcgagcgaatggattaagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaag

SEQ ID NO: 158 - DNA, 267 bp, Bacillus sp. 166amftsu
  ref <308>: DATABASE ACCESSION NUMBER: NCBI ACCESSION: NZ_FNQA01000009.1
  ref <309>: DATABASE ENTRY DATE: 2019-04-01
  ref <313>: RELEVANT RESIDUES IN SEQ ID NO: (1)..(267)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgcgctgcatggcgcgaaattgaaaggcggcttcggctgtcacttatggatggacccgcgtcgcattagctagttggtga

SEQ ID NO: 159 - DNA, 1492 bp, Bacillus sp. 196mf
  ref <308>: DATABASE ACCESSION NUMBER: NCBI ACCESSION: NZ_QJTG01000124.1
  ref <309>: DATABASE ENTRY DATE: 2019-04-01
  ref <313>: RELEVANT RESIDUES IN SEQ ID NO: (1)..(1492)
tttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagat

SEQ ID NO: 160 - DNA, 1555 bp, Bacillus sp. 1s-1
  ref <308>: DATABASE ACCESSION NUMBER: NCBI ACCESSION: NZ_CP022874.1
  ref <309>: DATABASE ENTRY DATE: 2019-04-01
  ref <313>: RELEVANT RESIDUES IN SEQ ID NO: (1)..(1555)
tttcatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttcaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 161 - DNA, 1555 bp, Bacillus sp. 2A25
  ref <308>: DATABASE ACCESSION NUMBER: NCBI ACCESSION: NZ_RPSK01000066.1
  ref <309>: DATABASE ENTRY DATE: 2019-04-01
  ref <313>: RELEVANT RESIDUES IN SEQ ID NO: (1)..(1555)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttct

SEQ ID NO: 162 - DNA, 1555 bp, Bacillus sp. 2A33; identical to SEQ ID NO: 63
  ref <308>: DATABASE ACCESSION NUMBER: NCBI ACCESSION: NZ_RQIU01000075.1
  ref <309>: DATABASE ENTRY DATE: 2019-04-01
  ref <313>: RELEVANT RESIDUES IN SEQ ID NO: (1)..(1555)

SEQ ID NO: 163 - DNA, 1548 bp, Bacillus sp. 2B09; identical to SEQ ID NO: 65
  ref <308>: DATABASE ACCESSION NUMBER: NCBI ACCESSION: NZ_RPSG01000018.1
  ref <309>: DATABASE ENTRY DATE: 2019-04-01
  ref <313>: RELEVANT RESIDUES IN SEQ ID NO: (1)..(1548)

SEQ ID NO: 164 - DNA, 539 bp, Bacillus sp. 2B10
  ref <308>: DATABASE ACCESSION NUMBER: NCBI ACCESSION: NZ_RPSH01000080.1
  ref <309>: DATABASE ENTRY DATE: 2019-04-01
  ref <313>: RELEVANT RESIDUES IN SEQ ID NO: (1)..(539)
agagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttgg

SEQ ID NO: 165 - DNA, 1315 bp, Bacillus sp. 2D02
  ref <308>: DATABASE ACCESSION NUMBER: NCBI ACCESSION: NZ_RPSI01000009.1
  ref <309>: DATABASE ENTRY DATE: 2019-04-01
  ref <313>: RELEVANT RESIDUES IN SEQ ID NO: (1)..(1315)
acccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttcta

SEQ ID NO: 166 - DNA, 1555 bp, Bacillus sp. 2D03; identical to SEQ ID NO: 63
  ref <308>: DATABASE ACCESSION NUMBER: NCBI ACCESSION: NZ_RPSJ01000038.1
  ref <309>: DATABASE ENTRY DATE: 2019-04-01
  ref <313>: RELEVANT RESIDUES IN SEQ ID NO: (1)..(1555)

SEQ ID NO: 167 - DNA, 1555 bp, Bacillus sp. 2 A 57 CT2
  ref <308>: DATABASE ACCESSION NUMBER: NCBI ACCESSION: NZ_GL635773.1
  ref <309>: DATABASE ENTRY DATE: 2019-04-01
  ref <313>: RELEVANT RESIDUES IN SEQ ID NO: (1)..(1555)
ttatatggagagtttgatcctggctcaggacgaacgctggcggcgtgcctaatacatgcaagtcgagcggacagatgggagcttgctccctgaagtcagcggcggacgggtgagtaacacgtgggcaacctgcctgtaagactgggataactccgggaaaccggggctaataccggataattctttccctcacatgagggaaagctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 168 - DNA, 1552 bp, Bacillus sp. 3-2-2
  ref <308>: DATABASE ACCESSION NUMBER: NCBI ACCESSION: NZ_QYTV02000021.1
  ref <309>: DATABASE ENTRY DATE: 2019-04-01
  ref <313>: RELEVANT RESIDUES IN SEQ ID NO: (1)..(1552)
tttatgagagtttgatcctggctcaggacgaacgctggcggcgtgcctaatacatgcaagtcgagcggatgaagaggagcttgctccttggattcagcggcggacgggtgagtaacacgtgggcaacctgcctgtaagactgggataactccgggaaaccggggctaataccggataacttcttttctcgcatgggaagaggttgaaagacggttttgctgtcacttacagatgggcccgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggccttcgggtcgtaaaactctgttatcagggaagaacaagcatcatttaactgatggtgccttgacggtacctgaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagagaacaggattagataccctggtattccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtgcagagatgtgcctttcccttcggggacagcggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacagagggcagcgagaccgcgaggttcagcgaatcccttaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacccttctgggagccagccgccgaaggtgggacagatgattggggtgaagtcgtaacaaggtagccgtatcggaaggtgcggctggatcacctcctttcta

SEQ ID NO: 169 - DNA, 251 bp, Bacillus sp. 491mf
  ref <308>: DATABASE ACCESSION NUMBER: NCBI ACCESSION: NZ_FOLV01000076.1
  ref <309>: DATABASE ENTRY DATE: 2019-04-01
  ref <313>: RELEVANT RESIDUES IN SEQ ID NO: (1)..(251)
tttattggagagtttgatcctggctcaggatgaacgctggcggcgtgcctaatacatgcaagtcgagcggaccaattaagagcttgctcttaagaagttagcggcggacgggtgagtaacacgtgggtaacctgcctataagactgggataactccgggaaaccggggctaataccggataacattttgcaccgcatggtgcgaaattgaaaggcggcttcggctgtcacttatagatggacctgcggcgc

SEQ ID NO: 170 - DNA, 288 bp, Bacillus sp. 5mfcol3.1
  ref <308>: DATABASE ACCESSION NUMBER: NCBI ACCESSION: NZ_FOST01000023.1
  ref <309>: DATABASE ENTRY DATE: 2019-04-01
  ref <313>: RELEVANT RESIDUES IN SEQ ID NO: (1)..(288)
tttattggagagtttgatcctggctcaggatgaacgctggcggcgtgcctaatacatgcaagtcgagcgaatggattgagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaa

SEQ ID NO: 171 - DNA, 284 bp, Bacillus sp. 71mf
  ref <308>: DATABASE ACCESSION NUMBER: NCBI ACCESSION: NZ_FOQX01000023.1
  ref <309>: DATABASE ENTRY DATE: 2019-04-01
  ref <313>: RELEVANT RESIDUES IN SEQ ID NO: (1)..(284)
tttattggagagtttgatcctggctcaggatgaacgctggcggcgtgcctaatacatgcaagtcgagcgaaccgattaagagcttgctcttaagaagttagcggcggacgggtgagtaacacgtaggtaacctgcctataagactgggataactccgggaaaccggggctaataccggataacattttgcaccgcatggtgcaaaattgaaaggcggcttcggctgtcacttatagatggacctgcggcgcattagctagttggtgaggtaacggctcaccaag

SEQ ID NO: 172 - DNA, 458 bp, Bacillus sp. 7504-2
  ref <308>: DATABASE ACCESSION NUMBER: NCBI ACCESSION: NZ_NPGC01000106.1
  ref <309>: DATABASE ENTRY DATE: 2019-04-01
  ref <313>: RELEVANT RESIDUES IN SEQ ID NO: (1)..(458)
gcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgccacccctagagatagggcgttccccttcgggggacggagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtggagcgaatcccataaaaccattctcagttcggattgtaggctgcaactcg

SEQ ID NO: 173 - DNA, 1555 bp, Bacillus sp. 7520-S
  ref <308>: DATABASE ACCESSION NUMBER: NCBI ACCESSION: NZ_NPGD01000140.1
  ref <309>: DATABASE ENTRY DATE: 2019-04-01
  ref <313>: RELEVANT RESIDUES IN SEQ ID NO: (1)..(1555)
tttaacggagagtttgatcctggctcaggacgaacgctggcggcgtgcctaatacatgcaagtcgagcggacagataaggagcttgctcctttgacgttagcggcggacgggtgagtaacacgtgggcaacctgccccttagactgggataactccgggaaaccggagctaataccggataatccctttctccacctggagagagggtgaaagatggcttcggctatcactaagggatgggcccgcggcgcattagctagttggtaaggtaacggcttaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgtgagggaagaagcggtaccgttcgaatagggcggtaccttgacggtacctcaccagaaagccacggctaactacgtgccagcagccgcggtaatacgtaggtggcaagcgttgtccggaattattgggcgtaaagcgcgcgcaggcggcttcttaagtctgatgtgaaatctcggggctcaaccccgagcggccattggaaactggggagcttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagttaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccacccaagagattgggcttccccttcgggggcaaagtgacaggtggtgcatggttgtcgtcagctcgtgtcgtgagatgttgggttaagtcccgcaacgagcgcaacccttgatcttagttgccagcattgagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaagccattctcagttcggattgcaggctgcaactcgcctgcatgaagccggaattgctagtaatcgcggatcagcatgccgcggtgaatacgttcccgggtcttgtacacaccgcccgtcacaccacgagagtttgtaacacccgaagtcggtgaggcaaccttttggagccagccgcctaaggtgggacaaatgattggggtgaagtcgtaacaaggtagccgtatcggaaggtgcggctggatcacctcctttcta

SEQ ID NO: 174 - DNA, 319 bp, Bacillus sp. 7586-K
  ref <308>: DATABASE ACCESSION NUMBER: NCBI ACCESSION: NZ_NPCL01000238.1
  ref <309>: DATABASE ENTRY DATE: 2019-04-01
  ref <313>: RELEVANT RESIDUES IN SEQ ID NO: (1)..(319)
aacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatccttcgctacttctagagatagaaggttccccttcgggggacggagtgacaggtggtgcatggttgtcgtcagctcgtgtcgtgagatgttgggttaagtc

SEQ ID NO: 175 - DNA, 735 bp, Bacillus sp. 7788
  ref <308>: DATABASE ACCESSION NUMBER: NCBI ACCESSION: NZ_NPDC01000064.1
  ref <309>: DATABASE ENTRY DATE: 2019-04-01
  ref <313>: RELEVANT RESIDUES IN SEQ ID NO: (1)..(735)
taaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 176 - DNA, 634 bp, Bacillus sp. 7884-1
  ref <308>: DATABASE ACCESSION NUMBER: NCBI ACCESSION: NZ_NPDD01000336.1
  ref <309>: DATABASE ENTRY DATE: 2019-04-01
  ref <313>: RELEVANT RESIDUES IN SEQ ID NO: (1)..(634)
aacgctggcggcgtgcctaatacatgcaagtcgagcgaatcttaaggtgcttgcaccttttggttagcggcggacgggtgagtaacacgtgggcaacctgcctgtaagactgggataacttcgggaaaccggagctaataccggataatccttttcctctcatgaggaaaagctgaaagtcggtttacgctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagtgtcattggaaactgggggacttgagtac

SEQ ID NO: 177 - DNA, 1341 bp, Bacillus sp. 7894-2
  ref <308>: DATABASE ACCESSION NUMBER: NCBI ACCESSION: NZ_NPDG01000113.1
  ref <309>: DATABASE ENTRY DATE: 2019-04-01
  ref <313>: RELEVANT RESIDUES IN SEQ ID NO: (1)..(1341)
ttatatggagagtttgatcctggctcaggacgaacgctggcggcgtgcctaatacatgcaagtcgagcggacagatgggagcttgctccctgaagtcagcggcggacgggtgagtaacacgtgggcaacctgcctgtaagactgggataactccgggaaaccggggctaataccggataactcttttcctcacatgagggaaagctaaaagatggtttcggctatcacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtaccggagtaactgccggtgccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcgaggttaagcgaatcccataaaaccattctcagttcggattgcaggctgcaactcgcctgcatga

SEQ ID NO: 178 - DNA, 1556 bp, Bacillus sp. 7 6 55CFAA CT2; identical to SEQ ID NO: 120
  ref <308>: DATABASE ACCESSION NUMBER: NCBI ACCESSION: NZ_JH414724.1
  ref <309>: DATABASE ENTRY DATE: 2019-04-01
  ref <313>: RELEVANT RESIDUES IN SEQ ID NO: (1)..(1556)

SEQ ID NO: 179 - DNA, 1554 bp, Bacillus sp. AFS001701
  ref <308>: DATABASE ACCESSION NUMBER: NCBI ACCESSION: NZ_NTZO01000002.1
  ref <309>: DATABASE ENTRY DATE: 2019-04-01
  ref <313>: RELEVANT RESIDUES IN SEQ ID NO: (1)..(1554)
ttttatggagagtttgatcctggctcaggacgaacgctggcggcgtgcctaatacatgcaagtcgagcggactaatgggagcttgctcccgttagttagcggcggacgggtgagtaacacgtgggcaacctacctgtaagactgggataacttcgggaaaccggagctaataccggatgacataaaggaactcctgttcctttattgaaagatggcctcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaataagtgctagttgaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 180 - DNA, 1554 bp, Bacillus sp. AFS002410
  ref <308>: DATABASE ACCESSION NUMBER: NCBI ACCESSION: NZ_NUEU01000094.1
  ref <309>: DATABASE ENTRY DATE: 2019-04-01
  ref <313>: RELEVANT RESIDUES IN SEQ ID NO: (1)..(1554)
ttttatggagagtttgatcctggctcaggacgaacgctggcggcgtgcctaatacatgcaagtcgagcggattaatgggagcttgctcccgttaattagcggcggacgggtgagtaacacgtgggcaacctacctataagactgggataacttcgggaaaccggagctaataccggatgacactgaggaactcctgttccttagttgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgctagttaaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggcgttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 181 - DNA, 1459 bp, Bacillus sp. AFS006103
  ref <308>: DATABASE ACCESSION NUMBER: NCBI ACCESSION: NZ_NTXX01000023.1
  ref <309>: DATABASE ENTRY DATE: 2019-04-01
  ref <313>: RELEVANT RESIDUES IN SEQ ID NO: (1)..(1459)
ttagcggcggacgggtgagtaacacgtgggcaacctgcctgtaagactgggataacaccgggaaaccggtgctaataccggataatccatttcctctcatgaggaaatgctgaaagtcggtttcggctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttcta

SEQ ID NO: 182 - DNA, 1556 bp, Bacillus sp. AFS012607
  ref <308>: DATABASE ACCESSION NUMBER: NCBI ACCESSION: NZ_NTVM01000029.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 183 - DNA, 1556 bp, Bacillus sp. AFS014408
  ref <308>: DATABASE ACCESSION NUMBER: NCBI ACCESSION: NZ_NUAB01000062.1
  ref <309>: DATABASE ENTRY DATE: 2019-04-01
  ref <313>: RELEVANT RESIDUES IN SEQ ID NO: (1)..(1556)
ctttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgcaccgcatggtgcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccatcattcagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 184 - DNA, 1556 bp, Bacillus sp. AFS015802
  ref <308>: DATABASE ACCESSION NUMBER: NCBI ACCESSION: NZ_NTUP01000058.1
  ref <309>: DATABASE ENTRY DATE: 2019-04-01
  ref <313>: RELEVANT RESIDUES IN SEQ ID NO: (1)..(1556)
tttatcggagagtttgatcctggctcaggacgaacgctggcggcgtgcctaatacatgcaagtcgagcggattgatgggagcttgctccctgatatcagcggcggacgggtgagtaacacgtgggtaacctgcctgtaagactgggataactccgggaaaccggggctaataccggataactcatttcctcgcatgaggaaatgttgaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggacggtacaaagggcagcgagaccgcgaggtttagccaatcccataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaa

SEQ ID NO: 185 - DNA, 1556 bp, Bacillus sp. AFS015896
  ref <308>: DATABASE ACCESSION NUMBER: NCBI ACCESSION: NZ_NTUO01000081.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 186 - DNA, 1552 bp, Bacillus sp. AFS017274
  ref <308>: DATABASE ACCESSION NUMBER: NCBI ACCESSION: NZ_NTTZ01000038.1
  ref <309>: DATABASE ENTRY DATE: 2019-04-01
  ref <313>: RELEVANT RESIDUES IN SEQ ID NO: (1)..(1552)
tcggagagtttgatcctggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaacctttatggagccagccgcctaaggtgggacagatgattggggtgaagtcgtaacaaggtagccgtatcggaaggtgcggctggatcacctcctttctaa

SEQ ID NO: 187 - DNA, 1554 bp, Bacillus sp. AFS017336
  ref <308>: DATABASE ACCESSION NUMBER: NCBI ACCESSION: NZ_NUCO01000140.1
  ref <309>: DATABASE ENTRY DATE: 2019-04-01
  ref <313>: RELEVANT RESIDUES IN SEQ ID NO: (1)..(1554)
ttttatggagagtttgatcctggctcaggacgaacgctggcggcgtgcctaatacatgcaagtcgagcggattaatgggagcttgctcccgttaattagcggcggacgggtgagtaacacgtgggcaacctacctgtaagactgggataacttcgggaaaccggagctaataccggatgacactgaggaactcctgttccttagttgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgctagttaaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggcgttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 188 - DNA, 1557 bp, Bacillus sp. AFS018417
  ref <308>: DATABASE ACCESSION NUMBER: NCBI ACCESSION: NZ_NTTM01000029.1
  ref <309>: DATABASE ENTRY DATE: 2019-04-01
  ref <313>: RELEVANT RESIDUES IN SEQ ID NO: (1)..(1557)
ctttattggagagtttgatcctggctcaggatgaacgctggcggcgtgcctaatacatgcaagtcgagcgaaccgattaagagcttgctcttaagaagttagcggcggacgggtgagtaacacgtaggtaacctgcctataagactgggataactccgggaaaccggggctaataccggataacattttgcaccgcatggtgcgaaattgaaaggcggcttcggctgtcacttatagatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgcaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagtcgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 189 - DNA, 1556 bp, Bacillus sp. AFS019443; identical to SEQ ID NO: 183
  ref <308>: DATABASE ACCESSION NUMBER: NCBI ACCESSION: NZ_NUAA01000012.1
  ref <309>: DATABASE ENTRY DATE: 2019-04-01
  ref <313>: RELEVANT RESIDUES IN SEQ ID NO: (1)..(1556)

SEQ ID NO: 190 - DNA, 1529 bp, Bacillus sp. AFS023182
  ref <308>: DATABASE ACCESSION NUMBER: NCBI ACCESSION: NZ_NTRO01000005.1
  ref <309>: DATABASE ENTRY DATE: 2019-04-01
  ref <313>: RELEVANT RESIDUES IN SEQ ID NO: (1)..(1529)
aggatgaacgctggcggcgtgcctaatacatgcaagtcgagcgaagggattaagagcttgctcttatgaagttagcggcggacgggtgagtaacacgtgggtaacctgcccataagactgggataactccgggaaaccggggctaataccggataacattttgcgcctcatggcgcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 191 - DNA, 1552 bp, Bacillus sp. AFS026049
  ref <308>: DATABASE ACCESSION NUMBER: NCBI ACCESSION: NZ_NUBA01000042.1
  ref <309>: DATABASE ENTRY DATE: 2019-04-01
  ref <313>: RELEVANT RESIDUES IN SEQ ID NO: (1)..(1552)
tcggagagtttgatcctggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctttctaa

SEQ ID NO: 192 - DNA, 1554 bp, Bacillus sp. AFS029533
  ref <308>: DATABASE ACCESSION NUMBER: NCBI ACCESSION: NZ_NUQC01000002.1
  ref <309>: DATABASE ENTRY DATE: 2019-04-01
  ref <313>: RELEVANT RESIDUES IN SEQ ID NO: (1)..(1554)
ttttatggagagtttgatcctggctcaggacgaacgctggcggcgtgcctaatacatgcaagtcgagcggactaatgggagcttgctcccgttagttagcggcggacgggtgagtaacacgtgggcaacctacctgtaagactgggataacttcgggaaaccggagctaataccggatgacataaaggaactcctgttcctttattgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaataagtgctagttgaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 193 - DNA, 1556 bp, Bacillus sp. AFS029637; identical to SEQ ID NO: 185
  ref <308>: DATABASE ACCESSION NUMBER: NCBI ACCESSION: NZ_NUPZ01000018.1
  ref <309>: DATABASE ENTRY DATE: 2019-04-01
  ref <313>: RELEVANT RESIDUES IN SEQ ID NO: (1)..(1556)

SEQ ID NO: 194 - DNA, 1555 bp, Bacillus sp. AFS031507
  ref <308>: DATABASE ACCESSION NUMBER: NCBI ACCESSION: NZ_NUOW01000026.1
  ref <309>: DATABASE ENTRY DATE: 2019-04-01
  ref <313>: RELEVANT RESIDUES IN SEQ ID NO: (1)..(1555)
tttcttggagagtttgatcctggctcaggacgaacgctggcggcgtgcctaatacatgcaagtcgagcgaatcaataggagcttgctcctgttggttagcggcggacgggtgagtaacacgtgggcaacctgcctgtaagactgggataacaccgggaaaccggtgctaataccggataatccttttcctctcatgaggaaaagctgaaagtcggtttcggctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 195 - DNA, 1556 bp, Bacillus sp. AFS033286; identical to SEQ ID NO: 185
  ref <308>: DATABASE ACCESSION NUMBER: NCBI ACCESSION: NZ_NUOG01000015.1
  ref <309>: DATABASE ENTRY DATE: 2019-04-01
  ref <313>: RELEVANT RESIDUES IN SEQ ID NO: (1)..(1556)

SEQ ID NO: 196 - DNA, 1551 bp, Bacillus sp. AFS037270
  ref <308>: DATABASE ACCESSION NUMBER: NCBI ACCESSION: NZ_NUNF01000012.1
  ref <309>: DATABASE ENTRY DATE: 2019-04-01
  ref <313>: RELEVANT RESIDUES IN SEQ ID NO: (1)..(1551)
atggagagtttgatcctggctcaggacgaacgctggcggcgtgcctaatacatgcaagtcgagcgaatcaataggagcttgctcctgttggttagcggcggacgggtgagtaacacgtgggcaacctgcctgtaagactgggataacaccgggaaaccggtgctaataccggataatccttttcctctcatgaggaaaagctgaaagtcggtttcggctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggaatttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaagccgcgaggcctagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 197 - DNA, 1555 bp, Bacillus sp. AFS040349
  ref <308>: DATABASE ACCESSION NUMBER: NCBI ACCESSION: NZ_NUMC01000063.1
  ref <309>: DATABASE ENTRY DATE: 2019-04-01
  ref <313>: RELEVANT RESIDUES IN SEQ ID NO: (1)..(1555)
tttattggagagtttgatcctggctcaggacgaacgctggcggcgtgcctaatacatgcaagtcgagcgaaccaatgggagcttgctccctgaggttagcggcggacgggtgagtaacacgtgggtaacctgcctgtaagattgggataactccgggaaaccggagctaataccggataacattttgaaccgcatggttcgaaattgaaagatggtttcggctatcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatccttcgctacttctagagatagaaggttccccttcgggggacgaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 198 - DNA, 1554 bp, Bacillus sp. AFS041924
  ref <308>: DATABASE ACCESSION NUMBER: NCBI ACCESSION: NZ_NULG01000014.1
  ref <309>: DATABASE ENTRY DATE: 2019-04-01
  ref <313>: RELEVANT RESIDUES IN SEQ ID NO: (1)..(1554)
ttttatggagagtttgatcctggctcaggacgaacgctggcggcgtgcctaatacatgcaagtcgagcggactaatgggagcttgctcccgttagttagcggcggacgggtgagtaacacgtgggcaacctacctgtaagactgggataacttcgggaaaccggagctaataccggatgacactgaggaactcctgttccttagttgaaagatggcctcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgctagttaaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggcgttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 199 - DNA, 1552 bp, Bacillus sp. AFS043905; identical to SEQ ID NO: 191
  ref <308>: DATABASE ACCESSION NUMBER: NCBI ACCESSION: NZ_NUSS01000004.1
  ref <309>: DATABASE ENTRY DATE: 2019-04-01
  ref <313>: RELEVANT RESIDUES IN SEQ ID NO: (1)..(1552)

SEQ ID NO: 200 - DNA, 1556 bp, Bacillus sp. AFS051223
  ref <308>: DATABASE ACCESSION NUMBER: NCBI ACCESSION: NZ_NUQD01000004.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccacatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 201 - DNA, 1506 bp, Bacillus sp. AFS053548
  misc_feature (184)..(185): n is a, c, g, or t
  ref <308>: DATABASE ACCESSION NUMBER: NCBI ACCESSION: NZ_NUHI01000018.1
  ref <309>: DATABASE ENTRY DATE: 2019-04-01
  ref <313>: RELEVANT RESIDUES IN SEQ ID NO: (1)..(1506)
ttttatggagagtttgatcctggctcaggacgaacgctggcggcgtgcctaatacatgcaagtcgagcggattaatgggagcttgctcccgttagttagcggcggacgggtgagtaacacgtgggcaacctacctgtaagactgggataacttcgggaaaccggagctaataccggatgacatnngatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgctagttaaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 202 - DNA, 1556 bp, Bacillus sp. AFS054943; identical to SEQ ID NO: 185
  ref <308>: DATABASE ACCESSION NUMBER: NCBI ACCESSION: NZ_NUGV01000040.1
  ref <309>: DATABASE ENTRY DATE: 2019-04-01
  ref <313>: RELEVANT RESIDUES IN SEQ ID NO: (1)..(1556)

SEQ ID NO: 203 - DNA, 1555 bp, Bacillus sp. AFS055030
  ref <308>: DATABASE ACCESSION NUMBER: NCBI ACCESSION: NZ_NUGT01000010.1
  ref <309>: DATABASE ENTRY DATE: 2019-04-01
  ref <313>: RELEVANT RESIDUES IN SEQ ID NO: (1)..(1555)
ttttatggagagtttgatcctggctcaggacgaacgctggcggcgtgcctaatacatgcaagtcgagcggactaatgggagcttgctcccgttagttagcggcggacgggtgagtaacacgtgggcaacctacctgtaagactgggataacttcgggaaaccggagctaataccggatgacattaaggaactcctgttccttaattgaaagatggcttttagctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgctagttgaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 204 - DNA, 1556 bp, Bacillus sp. AFS059628
  ref <308>: DATABASE ACCESSION NUMBER: NCBI ACCESSION: NZ_NVEC01000020.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 205 - DNA, 1299 bp, Bacillus sp. AFS073361
  ref <308>: DATABASE ACCESSION NUMBER: NCBI ACCESSION: NZ_NUZU01000040.1
  ref <309>: DATABASE ENTRY DATE: 2019-04-01
  ref <313>: RELEVANT RESIDUES IN SEQ ID NO: (1)..(1299)
cacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggattttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaactataaggagccagccgcctaaggggggacagatgattggggtgaagtcgtaacaaggtagccgtatc

SEQ ID NO: 206 - DNA, 1556 bp, Bacillus sp. AFS075034; identical to SEQ ID NO: 183
  ref <308>: DATABASE ACCESSION NUMBER: NCBI ACCESSION: NZ_NVES01000043.1
  ref <309>: DATABASE ENTRY DATE: 2019-04-01
  ref <313>: RELEVANT RESIDUES IN SEQ ID NO: (1)..(1556)

SEQ ID NO: 207 - DNA, 1556 bp, Bacillus sp. AFS075960
  ref <308>: DATABASE ACCESSION NUMBER: NCBI ACCESSION: NZ_NVER01000056.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 208 - DNA, 1551 bp, Bacillus sp. AFS076308; identical to SEQ ID NO: 196
  ref <308>: DATABASE ACCESSION NUMBER: NCBI ACCESSION: NZ_NUYW01000011.1
  ref <309>: DATABASE ENTRY DATE: 2019-04-01
  ref <313>: RELEVANT RESIDUES IN SEQ ID NO: (1)..(1551)

SEQ ID NO: 209 - DNA, 1554 bp, Bacillus sp. AFS077874; identical to SEQ ID NO: 179
  ref <308>: DATABASE ACCESSION NUMBER: NCBI ACCESSION: NZ_NUYF01000046.1
  ref <309>: DATABASE ENTRY DATE: 2019-04-01
  ref <313>: RELEVANT RESIDUES IN SEQ ID NO: (1)..(1554)

SEQ ID NO: 210 - DNA, 1554 bp, Bacillus sp. AFS088145
  ref <308>: DATABASE ACCESSION NUMBER: NCBI ACCESSION: NZ_NUUX01000016.1
  ref <309>: DATABASE ENTRY DATE: 2019-04-01
  ref <313>: RELEVANT RESIDUES IN SEQ ID NO: (1)..(1554)
ttttatggagagtttgatcctggctcaggacgaacgctggcggcgtgcctaatacatgcaagtcgagcggactaatgggagcttgctcccgttagttagcggcggacgggtgagtaacacgtgggcaacctacctgtaagactgggataacttcgggaaaccggagctaataccggatgacataaaggaactcctgttcctttattgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgctagttgaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 211 - DNA, 1552 bp, Bacillus sp. AFS094228; identical to SEQ ID NO: 191
  ref <308>: DATABASE ACCESSION NUMBER: NCBI ACCESSION: NZ_NVNR01000033.1
  ref <309>: DATABASE ENTRY DATE: 2019-04-01
  ref <313>: RELEVANT RESIDUES IN SEQ ID NO: (1)..(1552)

SEQ ID NO: 212 - DNA, 1556 bp, Bacillus sp. AFS094611; identical to SEQ ID NO: 185
  ref <308>: DATABASE ACCESSION NUMBER: NCBI ACCESSION: NZ_NVMH01000024.1
  ref <309>: DATABASE ENTRY DATE: 2019-04-01
  ref <313>: RELEVANT RESIDUES IN SEQ ID NO: (1)..(1556)

SEQ ID NO: 213 - DNA, 1554 bp, Bacillus sp. AFS096315; identical to SEQ ID NO: 179
  ref <308>: DATABASE ACCESSION NUMBER: NCBI ACCESSION: NZ_NVLP01000004.1
  ref <309>: DATABASE ENTRY DATE: 2019-04-01
  ref <313>: RELEVANT RESIDUES IN SEQ ID NO: (1)..(1554)

SEQ ID NO: 214 - DNA, 1556 bp, Bacillus sp. AFS098217; identical to SEQ ID NO: 183
  ref <308>: DATABASE ACCESSION NUMBER: NCBI ACCESSION: NZ_NVPR01000007.1
  ref <309>: DATABASE ENTRY DATE: 2019-04-01
  ref <313>: RELEVANT RESIDUES IN SEQ ID NO: (1)..(1556)

SEQ ID NO: 215 - DNA, 1556 bp, Bacillus sp. AG102; identical to SEQ ID NO: 182
  ref <308>: DATABASE ACCESSION NUMBER: NCBI ACCESSION: NZ_QPKA01000056.1
  ref <309>: DATABASE ENTRY DATE: 2019-04-01
  ref <313>: RELEVANT RESIDUES IN SEQ ID NO: (1)..(1556)

SEQ ID NO: 216 - DNA, 1551 bp, Bacillus sp. AG236
  ref <308>: DATABASE ACCESSION NUMBER: NCBI ACCESSION: NZ_QPJX01000023.1
  ref <309>: DATABASE ENTRY DATE: 2019-04-01
  ref <313>: RELEVANT RESIDUES IN SEQ ID NO: (1)..(1551)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttct

SEQ ID NO: 217 - DNA, 1548 bp, Bacillus sp. AG442
  ref <308>: DATABASE ACCESSION NUMBER: NCBI ACCESSION: NZ_QKZE01000019.1
  ref <309>: DATABASE ENTRY DATE: 2019-04-01
  ref <313>: RELEVANT RESIDUES IN SEQ ID NO: (1)..(1548)
tggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttcaatcataaaaggtggctttcagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttct

SEQ ID NO: 218 - DNA, 1239 bp, Bacillus sp. AKBS9
  ref <308>: DATABASE ACCESSION NUMBER: NCBI ACCESSION: NZ_POYG01000012.1
  ref <309>: DATABASE ENTRY DATE: 2019-04-01
  ref <313>: RELEVANT RESIDUES IN SEQ ID NO: (1)..(1239)
ggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagcc

SEQ ID NO: 219 - DNA, 1551 bp, Bacillus sp. ALD; identical to SEQ ID NO: 128
  ref <308>: DATABASE ACCESSION NUMBER: NCBI ACCESSION: NZ_QUQP01000033.1
  ref <309>: DATABASE ENTRY DATE: 2019-04-01
  ref <313>: RELEVANT RESIDUES IN SEQ ID NO: (1)..(1551)

SEQ ID NO: 220 - DNA, 1377 bp, Bacillus sp. AW
  ref <308>: DATABASE ACCESSION NUMBER: NCBI ACCESSION: NZ_QURA01000039.1
  ref <309>: DATABASE ENTRY DATE: 2019-04-01
  ref <313>: RELEVANT RESIDUES IN SEQ ID NO: (1)..(1377)
attttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttctatgga

SEQ ID NO: 221 - DNA, 1557 bp, Bacillus sp. B14905
  ref <308>: DATABASE ACCESSION NUMBER: NCBI ACCESSION: NZ_AAXV01000027.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcgaacagagaaggagcttgctccttcaacgttagcggcggacgggtgagtaacacgtgggcaacctaccttatagtttgggataactccgggaaaccggggctaataccgaataatctgtttcacctcatggtgaaacactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaa

SEQ ID NO: 222 - DNA, 1290 bp, Bacillus sp. BA3
  ref <308>: DATABASE ACCESSION NUMBER: NCBI ACCESSION: NZ_PIZR01000031.1
  ref <309>: DATABASE ENTRY DATE: 2019-04-01
  ref <313>: RELEVANT RESIDUES IN SEQ ID NO: (1)..(1290)
ggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaacctttatggagccagccgcctaaggtgggacagatgattggggtgaagtcgtaacaaggtagccgtatcggaaggtgcggctggatcacctcctttcta

SEQ ID NO: 223 - DNA, 1556 bp, Bacillus sp. BI3
  ref <308>: DATABASE ACCESSION NUMBER: NCBI ACCESSION: NZ_PJOQ01000034.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaacygcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 224 - DNA, 1262 bp, Bacillus sp. BO
  ref <308>: DATABASE ACCESSION NUMBER: NCBI ACCESSION: NZ_LT899437.1
  ref <309>: DATABASE ENTRY DATE: 2019-04-01
  ref <313>: RELEVANT RESIDUES IN SEQ ID NO: (1)..(1262)
cgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtcgggtagtaactgacccggccttgacggtacctaaccagaaagccccggctaactacgtgccagcagccgcggtaatacgtagggggcaagcgttgtccggaattattgggcgtaaagcgctcgcaggcggtcctttaagtctgatgtgaaatctcgcggctcaaccgcgaacggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgctattcctagagataggaagttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggaagcaaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 225 - DNA, 1554 bp, Bacillus sp. BS34A
  ref <308>: DATABASE ACCESSION NUMBER: NCBI ACCESSION: NZ_LN680001.1
  ref <309>: DATABASE ENTRY DATE: 2019-04-01
  ref <313>: RELEVANT RESIDUES IN SEQ ID NO: (1)..(1554)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 226 - DNA, 1550 bp, Bacillus sp. BT1B CT2
  ref <308>: DATABASE ACCESSION NUMBER: NCBI ACCESSION: NZ_GL635734.1
  ref <309>: DATABASE ENTRY DATE: 2019-04-01
  ref <313>: RELEVANT RESIDUES IN SEQ ID NO: (1)..(1550)
tggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttcaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 227 - DNA, 901 bp, Bacillus sp. C1-1
  ref <308>: DATABASE ACCESSION NUMBER: NCBI ACCESSION: NZ_RQRY01000016.1
  ref <309>: DATABASE ENTRY DATE: 2019-04-01
  ref <313>: RELEVANT RESIDUES IN SEQ ID NO: (1)..(901)
agcttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagtaaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggacgacgtcaaatcatcatgccccttatgacctgggctacacacgtgctacaatggatggtacaaagggcagcgaaaccgcgaggtggagccaatcccataaagccattctcagttcggattgtaggctgcaactcgcctacatgaagccggaattgctagtaatcgcggatcagcatgccgcggtgaatacgttcccgggtcttgtacacaccgcccgtcacaccacgagagtttgtaacacccgaagtcggtgaggtaaccttttggagccagccgcctaaggtgggacaaatgattggggtgaagtcgtaacaaggtagccgtatcggaaggtgcggctggatcacctcctttctatgga

SEQ ID NO: 228 - DNA, 1574 bp, Bacillus sp. CCTCCAB-2014251
  ref <308>: DATABASE ACCESSION NUMBER: NCBI ACCESSION: NZ_KZ119601.1
  ref <309>: DATABASE ENTRY DATE: 2019-04-01
  ref <313>: RELEVANT RESIDUES IN SEQ ID NO: (1)..(1574)
atttattggagagtttgatcctggctcaggacgaacgctggcggcgtgcctaatacatgcaagtcgagcgcaggaaacaggctgatcccttcggggtgatgcctgtggaatgagcggcggacgggtgagtaacacgtgggcaacctgccttacagactgggataactccgggaaaccggggctaataccggatgaccagaagaaccgcatggttctgctgtaaaagttgggacttgttcctaacactgtaagatgggcccgcggcgcattagctagttggtgaggtaacggctcaccaaggcgacgatgcgtagccgacctgagagggtgatcggccacactggaactgagacacggtccagactcctacgggaggcagcagtagggaatcatccgcaatgggcgaaagcctgacggtgcaacgccgcgtgaacgatgaaggtcttcggattgtaaagttctgttgtcagggaagaacacgtgccgttcgaacagggcggcaccttgacggtacctgaccagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggggacttgagtgtaggagaggaaagtggaattccacgtgtagcggtgaaatgcgtagatatgtggaggaacaccagtggcgaaggcgactttctggcctataactgacgctgaggcgcgaaagcgtggggagcaaacaggattagataccctggtagtccacgccgtaaacgatgagtgctaggtgttaggggtttcgatacccttagtgccgcagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgacaactctggagacagagcgttccccttcgggggacagagtgacaggtggtgcatggttgtcgtcagctcgtgtcgtgagatgttgggttaagtcccgcaacgagcgcaacccttgaccttagttgccagcatttagttgggcactctaaggtgactgccggtgacaaaccggaggaaggtggggatgacgtcaaatcatcatgccccttatgacctgggctacacacgtgctacaatgggtggtacaaagggcagcaaagccgcgaggccgagcgaatcccataaagccactctcagttcggattgcaggctgcaactcgcctgcatgaagccggaattgctagtaatcgcggatcagcatgccgcggtgaatacgttcccgggccttgtacacaccgcccgtcacaccacgagagcttgtaacacccgaagtcggtgaggtaaccttttggagccagccgccgaaggtgggacaggtgattggggtgaagtcgtaacaaggtatccctaccggaaggtggggatggatcacctcctttctaa

SEQ ID NO: 229 - DNA, 1555 bp, Bacillus sp. CDB3
  ref <308>: DATABASE ACCESSION NUMBER: NCBI ACCESSION: NZ_ALBR01000002.1
  ref <309>: DATABASE ENTRY DATE: 2019-04-01
  ref <313>: RELEVANT RESIDUES IN SEQ ID NO: (1)..(1555)
tttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttct

SEQ ID NO: 230 - DNA, 1551 bp, Bacillus sp. CGMCC 1.16541
  ref <308>: DATABASE ACCESSION NUMBER: NCBI ACCESSION: NZ_QFRU01000015.1
  ref <309>: DATABASE ENTRY DATE: 2019-04-01
  ref <313>: RELEVANT RESIDUES IN SEQ ID NO: (1)..(1551)
tcggagagtttgatcctggctcaggacgaacgctggcggcgtgcctaatacatgcaagtcgagcggactttttaaaagcttgcttttaaaaagtcagcggcggacgggtgagtaacacgtgggcaacctacctgtaagactgggataacttcgggaaaccggagctaataccgggtaatacttaacctcacatgaggttaagttgaaagatggtttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagagaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttct

SEQ ID NO: 231 - DNA, 1548 bp, Bacillus sp. CJCL2
  ref <308>: DATABASE ACCESSION NUMBER: NCBI ACCESSION: NZ_PVRG01000013.1
  ref <309>: DATABASE ENTRY DATE: 2019-04-01
  ref <313>: RELEVANT RESIDUES IN SEQ ID NO: (1)..(1548)
tcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttct

SEQ ID NO: 232 - DNA, 1555 bp, Bacillus sp. CMAA 1363
  ref <308>: DATABASE ACCESSION NUMBER: NCBI ACCESSION: NZ_MJGZ01000008.1
  ref <309>: DATABASE ENTRY DATE: 2019-04-01
  ref <313>: RELEVANT RESIDUES IN SEQ ID NO: (1)..(1555)
ttcggagagtttgatcctggctcaggatgaacgctggcggcgtgcctaatacatgcaagtcgagcgaactgattagaagcagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtatgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttct

SEQ ID NO: 233 - DNA, 414 bp, Bacillus sp. CX-1
  misc_feature (209)..(209): n is a, c, g, or t
  ref <308>: DATABASE ACCESSION NUMBER: NCBI ACCESSION: NZ_NCTZ01000125.1
  ref <309>: DATABASE ENTRY DATE: 2019-04-01
  ref <313>: RELEVANT RESIDUES IN SEQ ID NO: (1)..(414)
gaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcnttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagc

SEQ ID NO: 234 - DNA, 1556 bp, Bacillus sp. DB-2
  ref <308>: DATABASE ACCESSION NUMBER: NCBI ACCESSION: NZ_QNRN01000038.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctacccataagactgggataactccgggaaaccggggctaataccggataatattttgaactgcatagttcgaaattgaaaggcggcttcggctgtcacttatggatggacccgcgtcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaactctagagatagagcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 235 - DNA, 1553 bp, Bacillus sp. DM2
  ref <308>: DATABASE ACCESSION NUMBER: NCBI ACCESSION: NZ_CP030937.1
  ref <309>: DATABASE ENTRY DATE: 2019-04-01
  ref <313>: RELEVANT RESIDUES IN SEQ ID NO: (1)..(1553)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 236 - DNA, 1271 bp, Bacillus sp. DSM 27956
  ref <308>: DATABASE ACCESSION NUMBER: NCBI ACCESSION: NZ_MWSH01000049.1
  ref <309>: DATABASE ENTRY DATE: 2019-04-01
  ref <313>: RELEVANT RESIDUES IN SEQ ID NO: (1)..(1271)
acgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggcaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggacggtacaaagggcagcgagaccgcgaggtttagccaatcccataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaa

SEQ ID NO: 237 - DNA, 1552 bp, Bacillus sp. EAC
  ref <308>: DATABASE ACCESSION NUMBER: NCBI ACCESSION: NZ_NCSY01000008.1
  ref <309>: DATABASE ENTRY DATE: 2019-04-01
  ref <313>: RELEVANT RESIDUES IN SEQ ID NO: (1)..(1552)
ttatggagagtttgatcctggctcaggacgaacgctggcggcgtgcctaatacatgcaagtcgagcggacttgtaggagcttgctcctgcaggttagcggcggacgggtgagtaacacgtgggcaacctacctataagactgggataacttcgggaaaccggagctaataccggatgacacaaaggaactcctgttcctttgttgaaagatggcttcggctatcacttatagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtgctagttaaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggttttaaccgaagcaacgcgaagaaccttaccaggtcttgacatcctctgataaccctagagatagggcgttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 238 - DNA, 1556 bp, Bacillus sp. FDAARGOS 235
  ref <308>: DATABASE ACCESSION NUMBER: NCBI ACCESSION: NZ_CP020437.2
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 239 - DNA, 1557 bp, Bacillus sp. FJAT-42315
  ref <308>: DATABASE ACCESSION NUMBER: NCBI ACCESSION: NZ_KZ454941.1
  ref <309>: DATABASE ENTRY DATE: 2019-04-01
  ref <313>: RELEVANT RESIDUES IN SEQ ID NO: (1)..(1557)
ttatcggagagtttgatcctggctcaggacgaacgctggcggcgtgcctaatacatgcaagtcgagcggacttgataggagcttgcttctattcaagttagcggcggacgggtgagtaacacgtgggtaacctgcctgtaagactgggataactccgggaaaccggggctaataccggataacttctttctccgcatggagaaggattgaaagatggtttcggctatcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctggagacagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgcctaaggtgggacagatgattggggtgaagtcgtaacaaggtagccgtatcggaaggtgcggctggatcacctcctttct

SEQ ID NO: 240 - DNA, 1542 bp, Bacillus sp. FJAT-42376
  ref <308>: DATABASE ACCESSION NUMBER: NCBI ACCESSION: NZ_CP033906.1
  ref <309>: DATABASE ENTRY DATE: 2019-04-01
  ref <313>: RELEVANT RESIDUES IN SEQ ID NO: (1)..(1542)
tttttggagagtttgatcctggctcaggacgaacgctggcggcgtgcctaatacatgcaagtcgagcggatctcttcggagatcagcggcggacgggtgagtaacacgtgggcaacctgcctgtaagactgggataactccgggaaaccggagctaataccggataacctttcgaaccgcatggttcggaattgaaagacggttatgctgtcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgggagtcactgcccgcgccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactggaggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccacttctagagatagaaggttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggttcagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccgtaagggagccagccgcctaaggtggggcagatgattggggtgaagtcgtaacaaggtagccgtatcggaaggtgcggctggatcacctcctttcta

SEQ ID NO: 241 - DNA, 1572 bp, Bacillus sp. FJAT-44742
  ref <308>: DATABASE ACCESSION NUMBER: NCBI ACCESSION: NZ_KZ454936.1
  ref <309>: DATABASE ENTRY DATE: 2019-04-01
  ref <313>: RELEVANT RESIDUES IN SEQ ID NO: (1)..(1572)
tttatcggagagtttgatcctggctcaggacgaacgctggcggcgtgcctaatacatgcaagtcgagcgcaggaaacaagctgcgcccttcggggcaaagcttgtggaatgagcggcggacgggtgagtaacacgtgggcaacctgccttacagactgggataaccccgggaaaccggggctaatactggataatcaataagatcacatgatcttattgtaaaagttgggatttatcctaacactgtgagatgggcccgcggcgcattagctagttggcgaggtaacggctcaccaaggcgacgatgcgtagccgacctgagagggtgatcggccacactgggactgagacacggcccagactcctacgggaggcagcagtagggaatcatccgcaatgggcgaaagcctgacggtgcaacgccgcgtgagtgaagaaggttttcggatcgtaaagctctgttgtcagggaagaacaagtgccgtgcgaatagagcggcaccttgacggtacctgaccagaaagccccggctaactacgtgccagcagccgcggtaatacgtagggggcaagcgttgtccggaattattgggcgtaaagcgcgcgcaggcggtttcctaagtctgatgtgaaagcccacggctcaaccgtggagggtcattggaaactggggaacttgagtgcagaagaggagagtggaattccacgtgtagcggtgaaatgcgtagatatgtggaggaacaccagtggcgaaggcgactctctggtctgttactgacgctgaggtgcgaaagcgtggggagcaaacaggattagataccctggtagtccacgccgtaaacgttgagtgctaggtgtcaggggtttcgatgcccttggtgccgaagtaaacacattaagcactccgcctggggagtacgaccgcaaggttgaaactcaaaggaattgacgggggcccgcacaagcggtggagcatgtggtttaattcgaagcaacgcgaagaaccttaccaggtcttgacatcctctgaccgccctagagatagggtcttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacagagggttgcgagaccgcgaggttcagccaatcccaaaaagccattctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaaccttttaggagccagccgccgaaggtggggcaggtgattggggtgaagtcgtaacaaggtatccctaccggaaggtggggatggatcacctcctttcta

SEQ ID NO: 242 - DNA, 1560 bp, Bacillus sp. FJAT-44876
  ref <308>: DATABASE ACCESSION NUMBER: NCBI ACCESSION: NZ_NIST01000001.1
  ref <309>: DATABASE ENTRY DATE: 2019-04-01
  ref <313>: RELEVANT RESIDUES IN SEQ ID NO: (1)..(1560)
tttattggagagtttgatcctggctcaggacgaacgctggcggcgtgcctaatacatgcaagtcgagcggaccaactaagagcttgctcttaagaggtcagcggcggacgggtgagtaacacgtgggcaacctgccttgcagactgggataactccgggaaaccggggctaataccggatgatcaatggaactgcatagttctattgtaaaagtggggatttatcctcacactgcaagatgggcccgcggcgcattagctagttggtaaggtaatggcttaccaaggcgacgatgcgtagccgacctgagagggtgatcggccacactggaactgagacacggtccagactcctacgggaggcagcagtagggaatcatccgcaatgggcgaaagcctgacggtgcaacgccgcgtgagtgatgacggtcttcggattgtaaagctctgttgttagggaagaacaagtgctgttcgaatagggcggcaccttgacggtacctaaccagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggggacttgagtgtaggagaggaaagtggaattccacgtgtagcggtgaaatgcgtagatatgtggaggaacaccagtggcgaaggcgactttctggcctataactgacgctgaggcgcgaaagcgtggggagcaaacaggattagataccctggtagtccacgccgtaaacgttgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgaccaccctagagatagggctttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgagaccgcgaggttgagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagcttgtaacacccgaagtcggtgcggtaaccttttggagccagccgccgaaggtgggacaggtgattggggtgaagtcgtaacaaggtatccctaccggaaggtggggatggatcacctcctttctaa

SEQ ID NO: 243 - DNA, 1555 bp, Bacillus sp. FJAT-45037
  ref <308>: DATABASE ACCESSION NUMBER: NCBI ACCESSION: NZ_KZ454938.1
  ref <309>: DATABASE ENTRY DATE: 2019-04-01
  ref <313>: RELEVANT RESIDUES IN SEQ ID NO: (1)..(1555)
tttatggagagtttgatcctggctcaggacgaacgctggcggcgtgcctaatacatgcaagtcgagcggatcaaagggagcttgctccctttgattagcggcggacgggtgagtaacacgtgggcaacctacctataagattgggataactccgggaaaccggggctaataccgggtaatccgtttctccacatggaggaaaggtaaaagatggcttcggctatcacttgtagatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgtttgaataaggcggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggacgacgtcaaatcatcatgccccttatgacctgggctacacacgtgctacaatggatggtacaaagggctgcaaaaccgcgaggttgagcgaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 244 - DNA, 1602 bp, Bacillus sp. FJAT-45066
  ref <308>: DATABASE ACCESSION NUMBER: NCBI ACCESSION: NZ_NISQ01000001.1
  ref <309>: DATABASE ENTRY DATE: 2019-04-01
  ref <313>: RELEVANT RESIDUES IN SEQ ID NO: (1)..(1602)
tcggagagtttgatcctggctcaggacgaacgctggcggcgtgcctaatacatgcaagtcgagcgaatctgataaaagcttgcttttgtcagattagcggcggacgggtgagtaacacgtgggcaacctgcctgtaagactgggataacttcgggaaaccggagctaataccggataatataaagaacctcctggttctttattgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggaaacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatccttttgccttccctagagatagggcgttccccttcgggggacaaaagtgacaggtggtgcatggttgtcgtcagctcgtgtcgtgagatgttgggttaagtcccgcaacgagcgcaacccttgatcttagttgccagcattaagttgggcactctaagatgactgccggtgacaaaccggaggaaggtggggatgacgtcaaatcatcatgccccttatgacctgggctacacacgtgctacaatggacggtacaaagggcagcaaaaccgcgaggtcgagccaatcccataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctgggcacaacttagcctcttataattatgataggaagttaagttgtgcctaggagccagccgcctaaggtgggacagatgattggggtgaagtcgtaacaaggtagccgtatcggaaggtgcggctggatcacctcctttctaa

SEQ ID NO: 245 - DNA, 1556 bp, Bacillus sp. FJAT-45086
  ref <308>: DATABASE ACCESSION NUMBER: NCBI ACCESSION: NZ_KZ454943.1
  ref <309>: DATABASE ENTRY DATE: 2019-04-01
  ref <313>: RELEVANT RESIDUES IN SEQ ID NO: (1)..(1556)
tttatggagagtttgatcctggctcaggacgaacgctggcggcgtgcctaatacatgcaagtcgagcggacctttaggagcttgctcctaaaggttagcggcggacgggtgagtaacacgtgggcaacctgccccttagaccgggataacatcgagaaatcggtgctaataccggatgatagaacgagcgttcatgcgcatgttctcaaagatggctccggctatcactaagggatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgtcgttcaaatagggcggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgaccttagttgccagcatttagttgggcactctaaggtgactgccggtgataaaccggaggaaggtggggatgacgtcaaatcatcatgccccttatgacctgggctacacacgtgctacaatggatggtacaaagggttgcgaagccgcgaggtggagccaatcccagaaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 246 - DNA, 1600 bp, Bacillus sp. FJAT-45122
  ref <308>: DATABASE ACCESSION NUMBER: NCBI ACCESSION: NZ_KZ454944.1
  ref <309>: DATABASE ENTRY DATE: 2019-04-01
  ref <313>: RELEVANT RESIDUES IN SEQ ID NO: (1)..(1600)
tcggagagtttgatcctggctcaggacgaacgctggcggcgtgcctaatacatgcaagtcgagcgaatctgataaaagcttgctttttgaagattagcggcggacgggtgagtaccacgtgggcaacctgcctgtaagactgggataacttcgggagaccggagctaataccggataatataaagaacctcctggttctttattgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggactcttccacactggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggacactgggaaacttgagtgcagaagaggaaagtggaattccacgtgtagcggtgaaatgcgtagagatgtggaggaacaccagtggcgaaggcgactttctggtctgtaactgacgctgaggcgcgaaagcctggggagcaaacaggattagataccctggtagtccacgccgtaaacgatgagtgctaagtgttagggggtttccgccccttagtgctgcagctaacgcattaagcactccgcctggggagtacggtcgcaagactgaatctcaaaggaattgacgggggcccgcacaagcggtggagcatgtggtttaattcgaagcaacgcgaagaaccttaccaggtcttgacatccttttgccttccctagagatagggcgttccccctcgggggacaaaagtgacaggtggtgcatggttgtcgtcagctcgtgtcgtgagatgttgggttaagtcccgcaacgagcgcaacccttgatcttagttgccagcattaagttgggcactctaagatgactgccggtgacacaccggaggaaggtggggatgacgtcaaatcatcatgccccttatgacctgggctacacacgtgctacaatggacggtacaaagggcagcaaaaccgcgaggtcgagccaatcccataaaaccgttctcagttcggattgtaggctgcaactcgcctccatgaagctggaatcgctagtaatcgcggatcagcatgccgcggtgaatacgttcccgggccttgtacacaccgcccgtcacaccacgagagtttgtaacacccgaagtcggtggggtaacctgggcacaacttagcctcttataattatgataggaagttaagttgtgcctaggagccagccgcctaaggtgggacagatgattggggtgaagtcgtaacaaggtagccgtatcggaaggtgcggctggatcacctcctttct

SEQ ID NO: 247 - DNA, 1567 bp, Bacillus sp. FJAT-45348
  ref <308>: DATABASE ACCESSION NUMBER: NCBI ACCESSION: NZ_CP025024.1
  ref <309>: DATABASE ENTRY DATE: 2019-04-01
  ref <313>: RELEVANT RESIDUES IN SEQ ID NO: (1)..(1567)
tacggagagtttgatcctggctcaggacgaacgctggcggcgtgcctaatacatgcaagtcgagcgcgggaagcaagtgaatcccttcggggtgaaacttgtggaacgagcggcggacgggtgagtaacacgtgggcaacctgcctcacagactgggataactccgggaaaccggggctaataccggatgatcaaagggatcgcatgattcttttgtaaaagttgggttttacctaacactgtgagatgggcccgcggcgcattagctagttggtgaggtagtggctcaccaaggcgacgatgcgtagccgacctgagagggtgatcggccacactgggactgagacacggcccagactcctacgggaggcagcagtagggaatcatccgcaatgggcgaaagcctgacggtgcaacgccgcgtgagtgatgacggtcttcggattgtaaagctctgttgttagggaagaacaagtgccgtgcgaatagagcggcaccttgacggtacctaaccagaaagccccggctaactacgtgccagcagccgcggtaatacgtagggggcaagcgttgtccggaattattgggcgtaaagcgcgcgcaggcggttctttaagtctgatgtgaaagcccacggctcaaccgtggagggtcattggaaactggggaacttgagtgtaggagaggaaagtggaattccaagtgtagcggtgaaatgcgtagatatttggaggaacaccagtggcgaaggcgactttctggcctacaactgacgctgaggcgcgaaagcgtggggagcaaacaggattagataccctggtagtccacgccgtaaacgatgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgacacccttagagataaggctttccccttcgggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggcagcaaagccgcgaggccgagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagcttgtaacacccgaagtcggtgcggtaaccttttggagccagccgccgaaggtgggacaggtgattggggtgaagtcgtaacaaggtatccctaccggaaggtggggatggatcacctcctttcta

SEQ ID NO: 248 - DNA, 1551 bp, Bacillus sp. FJAT-45350
  ref <308>: DATABASE ACCESSION NUMBER: NCBI ACCESSION: NZ_NISU01000001.1
  ref <309>: DATABASE ENTRY DATE: 2019-04-01
  ref <313>: RELEVANT RESIDUES IN SEQ ID NO: (1)..(1551)
cggagagtttgatcctggctcaggacgaacgctggcggcgtgcctaatacatgcaagtcgagcggactgaagggagcttgctcccggacgttagcggcggacgggtgagtaacacgtaggcaacctgccttgtagactgggataacttcgggaaaccggagctaataccggatgttagataattcgcgcatgcgtgttatcttaaagttggcctcggctaacactacaagatgggcctgcggcgcattagctagttggtaaggtagtggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggttgagccaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 249 - DNA, 1556 bp, Bacillus sp. FJAT-45385
  ref <308>: DATABASE ACCESSION NUMBER: NCBI ACCESSION: NZ_MVJM01000001.1
  ref <309>: DATABASE ENTRY DATE: 2019-04-01
  ref <313>: RELEVANT RESIDUES IN SEQ ID NO: (1)..(1556)
tttatggagagtttgatcctggctcaggacgaacgctggcggcgtgcctaatacatgcaagtcgagcggactgattaagagcttgctcttaagacgttagcggcggacgggtgagtaacacgtgggcaacctgccccttagactgggataacatcgagaaatcggtgctaataccgggtaagagatgcaaccgcatggttgtgtcataaaagatggctccggctatcactaagggatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggatttcggttcgtaaaactctgttgttagggaagaacacgtgccgttcgaatagggcggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactgggagacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgacgttaacacattaagcactccgcctggggagtacggccgcaaggctgaaactcaaaggaattgacgggggcccgcacaagcagtggagcatgtggtttaattcgaagcaacgcgaagaaccttaccaggtcttgacatccttatgccctccctagagatagggatttcccttcggggacataagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggtagcgaagccgcgaggtggagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 250 - DNA, 1567 bp, Bacillus sp. FJAT-45505
  ref <308>: DATABASE ACCESSION NUMBER: NCBI ACCESSION: NZ_KZ454935.1
  ref <309>: DATABASE ENTRY DATE: 2019-04-01
  ref <313>: RELEVANT RESIDUES IN SEQ ID NO: (1)..(1567)
tttattgagagtttgatcttggctcaggacgaacgctggcggcgtgcctaatacatgcaagtcgagcgcgggaagcaaaaagatctcttcggagtgacatttgtggaacgagcggcggacgggtgagtaacacgtgggcaacctgcctgtaagactgggataactccgggaaaccggggctaataccggataatacttttcttcgcatgaaggaaagttgaaagatggcctttggctatcacttacagatgggcccgcggcgcattagctagttggtgaggtaagagctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaacaagtaccgttcaaatagggcggtaccttgacggtacctatcgaggaagccccggctaactacgtgccagcagccgcggtaatacgtagggggcaagcgttgtccggaattattgggcgtaaagcgcgcgtaggcggtttcttaagtctgatgtgaaatcttgcggctcaaccgcaagcggtcattggaaactggggaacttgagtgcagaagaggagagcggaattccacgtgtagcggtgaaatgcgtagatatgtggaggaacaccagtggcgaaggcggctctctggtctgtaactgacgctgaggtgcgaaagcgtggggagcgaacaggattagataccctggtagtccacgccgtaaacgatgagtgctaggtgttagggggtttccgccccttagtgctgcagttaacgcaataagcactccgcctggggagtacggccgcaaggctgaaactcaaaagaattgacgggggcccgcacaagcggtggagcatgtggtttaattcgaagcaacgcgaagaaccttaccaggtcttgacatcttcggatgtccctagagatagggagttcccttcggggaccgaatgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggcagcgaagcggcaacgcattagcaaatcccataaatccattctcagttcggattgcaggctgcaactcgcctgtatgaagccggaatcgctagtaatcgtggatcagcatgccacggtgaatacgttcccgggccttgtacacaccgcccgtcacaccacgagagttggcaacacccgaagtcggtggggtaacctttggagccagccgccgaaggtggggccaatgattggggtgaagtcgtaacaaggtagccgtatcggaaggtgcggctggatcacctcctttcta

SEQ ID NO: 251 - DNA, 1558 bp, Bacillus sp. FJAT-46582
  ref <308>: DATABASE ACCESSION NUMBER: NCBI ACCESSION: NZ_KZ454939.1
  ref <309>: DATABASE ENTRY DATE: 2019-04-01
  ref <313>: RELEVANT RESIDUES IN SEQ ID NO: (1)..(1558)
ttatcggagagtttgatcctggctcaggacgaacgctggcggcgtgcctaatacatgcaagtcgagcggacttagcgggagcttgctcctgcttgagtcagcggcggacgggtgagtaacacgtgggtaacctgcctgtaagacggggataactccgggaaaccggggctaataccggataagttctttcttcgcatgaaggaagattgaaaggcggcttcggctgtcgcttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtgtcggagtaactgccggcaccttgacggtacctgaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaccgctctggagacagagctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgcctaaggtggggcagatgattggggtgaagtcgtaacaaggtagccgtatcggaaggtgcggctggatcacctcctttcta

SEQ ID NO: 252 - DNA, 1548 bp, Bacillus sp. GBSC66; identical to SEQ ID NO: 231
  ref <308>: DATABASE ACCESSION NUMBER: NCBI ACCESSION: NZ_PVQY01000019.1
  ref <309>: DATABASE ENTRY DATE: 2019-04-01
  ref <313>: RELEVANT RESIDUES IN SEQ ID NO: (1)..(1548)

SEQ ID NO: 253 - DNA, 1548 bp, Bacillus sp. GBSW19; identical to SEQ ID NO: 231
  ref <308>: DATABASE ACCESSION NUMBER: NCBI ACCESSION: NZ_PVRF01000009.1
  ref <309>: DATABASE ENTRY DATE: 2019-04-01
  ref <313>: RELEVANT RESIDUES IN SEQ ID NO: (1)..(1548)

SEQ ID NO: 254 - DNA, 1548 bp, Bacillus sp. GBSW2; identical to SEQ ID NO: 231
  ref <308>: DATABASE ACCESSION NUMBER: NCBI ACCESSION: NZ_PVRC01000014.1
  ref <309>: DATABASE ENTRY DATE: 2019-04-01
  ref <313>: RELEVANT RESIDUES IN SEQ ID NO: (1)..(1548)

SEQ ID NO: 255 - DNA, 270 bp, Bacillus sp. GL120224-02
  ref <308>: DATABASE ACCESSION NUMBER: NCBI ACCESSION: NZ_OBED01000020.1
  ref <309>: DATABASE ENTRY DATE: 2019-04-01
  ref <313>: RELEVANT RESIDUES IN SEQ ID NO: (1)..(270)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaa

SEQ ID NO: 256 - DNA, 1555 bp, Bacillus sp. H1a; identical to SEQ ID NO: 141
  ref <308>: DATABASE ACCESSION NUMBER: NCBI ACCESSION: NZ_AYMH01000044.1
  ref <309>: DATABASE ENTRY DATE: 2019-04-01
  ref <313>: RELEVANT RESIDUES IN SEQ ID NO: (1)..(1555)

SEQ ID NO: 257 - DNA, 1556 bp, Bacillus sp. H1m; identical to SEQ ID NO: 182
  ref <308>: DATABASE ACCESSION NUMBER: NCBI ACCESSION: NZ_AYMM01000016.1
  ref <309>: DATABASE ENTRY DATE: 2019-04-01
  ref <313>: RELEVANT RESIDUES IN SEQ ID NO: (1)..(1556)

SEQ ID NO: 258 - DNA, 1556 bp, Bacillus sp. HBCD-sjtu
  ref <308>: DATABASE ACCESSION NUMBER: NCBI ACCESSION: NZ_CP025122.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaagctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 259 - DNA, 1555 bp, Bacillus sp. HMA207
  ref <308>: DATABASE ACCESSION NUMBER: NCBI ACCESSION: NZ_BEZT01000018.1
  ref <309>: DATABASE ENTRY DATE: 2019-04-01
  ref <313>: RELEVANT RESIDUES IN SEQ ID NO: (1)..(1555)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttct

SEQ ID NO: 260 - DNA, 1591 bp, Bacillus sp. HMF5848
  ref <308>: DATABASE ACCESSION NUMBER: NCBI ACCESSION: NZ_RWIV01000001.1
  ref <309>: DATABASE ENTRY DATE: 2019-04-01
  ref <313>: RELEVANT RESIDUES IN SEQ ID NO: (1)..(1591)
tttcggagagtttgatcctggctcaggacgaacgctggcggcgtgcctaatacatgcaagtcgagcgaaccacttcggtggttagcggcggacgggtgagtaacacgtgggcaacctgcctatgagactgggataacttcgggaaaccggagctaataccggataacttttatctttgcctgaagataaattgaaagatggcttttagctatcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgttagggaagaacaagtaccgttcgaatagggcggtaccttgacggtacctaacgagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggagagtggaattccacgtgtagcggtgaaatgcgtagatatgtggaggaacaccagtggcgaaggcgactctctggtctgtaactgacgctgaggcgcgaaagcgtggggagcgaacaggattagataccctggtagtccacgccgtaaacgatgagtgctaagtgttggagggtttccgcccttcagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatccctatgcccgccctagagatagggttttcccttcggggacataggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaaaaccgcgaggttgagcgaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctggggcaaaacttaacctcttatatttatgataggaagttaagttttgccctaggagccagccgcctaaggtgggacagatgattggggtgaagtcgtaacaaggtagccgtatcggaaggtgcggctggatcacctcctttcta

SEQ ID NO: 261 - DNA, 1548 bp, Bacillus sp. HMG; identical to SEQ ID NO: 65
  ref <308>: DATABASE ACCESSION NUMBER: NCBI ACCESSION: NZ_QUQY01000010.1
  ref <309>: DATABASE ENTRY DATE: 2019-04-01
  ref <313>: RELEVANT RESIDUES IN SEQ ID NO: (1)..(1548)

SEQ ID NO: 262 - DNA, 1554 bp, Bacillus sp. HNG
  ref <308>: DATABASE ACCESSION NUMBER: NCBI ACCESSION: NZ_QUQV01000049.1
  ref <309>: DATABASE ENTRY DATE: 2019-04-01
  ref <313>: RELEVANT RESIDUES IN SEQ ID NO: (1)..(1554)
ttattggagagtttgatcctggctcaggatgaacgctggcggcgtgcctaatacatgcaagtcgagcgaatctgagggagcttgctcccaaagattagcggcggacgggtgagtaacacgtgggcaacctgcctgtaagactgggataacttcgggaaaccggagctaataccggataacatatgagaccacatggtctcgtattaaaagatggcttttagctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtatcgttcgaatagggcggtaccttgacggtacctaaccagaaagccacggctaactacgtgccagcagccgcggtaatacgtaggtggcaagcgttatccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacactcctagagataggattttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggttaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttct

SEQ ID NO: 263 - DNA, 1555 bp, Bacillus sp. ISO11; identical to SEQ ID NO: 259
  ref <308>: DATABASE ACCESSION NUMBER: NCBI ACCESSION: NZ_QXCO01000079.1
  ref <309>: DATABASE ENTRY DATE: 2019-04-01
  ref <313>: RELEVANT RESIDUES IN SEQ ID NO: (1)..(1555)

SEQ ID NO: 264 - DNA, 1558 bp, Bacillus sp. JCA
  ref <308>: DATABASE ACCESSION NUMBER: NCBI ACCESSION: NZ_LN623569.1
  ref <309>: DATABASE ENTRY DATE: 2019-04-01
  ref <313>: RELEVANT RESIDUES IN SEQ ID NO: (1)..(1558)
tttcttggagagtttgatcctggctcaggacgaacgctggcggcgtgcctaatacatgcaagtcgagcgaatctttaggagcttgctcctgaaggttagcggcggacgggtgagtaacacgtgggcaacctgcctgtaagactgggataacatcgggaaaccgatgctaataccggataatccttttcctctcatgaggaaaagctgaaagtcggcctctcgctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttatgccttccctagagatagggctttccccttcgggggacgtaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaagtcgcaagacctagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 265 - DNA, 1555 bp, Bacillus sp. JCM 19035
  ref <308>: DATABASE ACCESSION NUMBER: NCBI ACCESSION: NZ_BAXP01000042.1
  ref <309>: DATABASE ENTRY DATE: 2019-04-01
  ref <313>: RELEVANT RESIDUES IN SEQ ID NO: (1)..(1555)
ttttaacggagagtttgatcctggctcaggacgaacgctggcggcatgcctaatacatgcaagtcgagcggacagaagggagcttgctcccggaagtcagcggcggacgggtgagtaacacgtgggcaacctgccccttagattgggataacttcgggaaaccgaagctaataccgaataatacaaggaacctcctggttctctgttgaaagatggcctttgtgctgtcactaagggatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaatgccgcgtgagtgaggaaggccttcgggtcgtaaagctctgttgtgagggaagaacaagtaccggcgtaactaccggtaccgtgacggtacctcaccagaaagccacggctaactacgtgccagcagccgcggtaatacgtaggtggcaagcgttgtccggaattattgggcgtaaagcgcgcgcaggcggcttcttaagtctgatgtgaaatctcggggctcaaccccgagcggccattggaaactgggaagcttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagtaaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggacgacgtcaaatcatcatgccccttatgacctgggctacacacgtgctacaatggatggtacaaagggttgcgaagccgtgaggtggagccaatcccataaagccattctcagttcggattgtaggctgcaactcgcctacatgaagccggaattgctagtaatcgcggatcagcatgccgcggtgaatacgttcccgggtcttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 266 - DNA, 594 bp, Bacillus sp. JEM-1
  ref <308>: DATABASE ACCESSION NUMBER: NCBI ACCESSION: NZ_NCLG01000094.1
  ref <309>: DATABASE ENTRY DATE: 2019-04-01
  ref <313>: RELEVANT RESIDUES IN SEQ ID NO: (1)..(594)
attgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaccgccgcgtgagtgatgaaggctttcgggtcgtaaaactctgttgttcgggaagaacaagtgctagttgaataagctggcgccttgacggtacctaaccagaaagccacggctaactacgtgcccgcagccgcggtaatacgtaggtggcaagcgttatccggaattattgggcgtaaagcgcgcgcaggtggtttcttaagtctgatgtgaacgcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggatt

SEQ ID NO: 267 - DNA, 1556 bp, Bacillus sp. JS
  ref <308>: DATABASE ACCESSION NUMBER: NCBI ACCESSION: NC_017743.1
  ref <309>: DATABASE ENTRY DATE: 2019-04-01
  ref <313>: RELEVANT RESIDUES IN SEQ ID NO: (1)..(1556)
atttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 268 - DNA, 1556 bp, Bacillus sp. K2I17
  ref <308>: DATABASE ACCESSION NUMBER: NCBI ACCESSION: NZ_NJGF01000117.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 269 - DNA, 1555 bp, Bacillus sp. K6W; identical to SEQ ID NO: 259
  ref <308>: DATABASE ACCESSION NUMBER: NCBI ACCESSION: NZ_QMGC01000102.1
  ref <309>: DATABASE ENTRY DATE: 2019-04-01
  ref <313>: RELEVANT RESIDUES IN SEQ ID NO: (1)..(1555)

SEQ ID NO: 270 - DNA, 1557 bp, Bacillus sp. KQ-3
  ref <308>: DATABASE ACCESSION NUMBER: NCBI ACCESSION: NZ_RHIB01000008.1
  ref <309>: DATABASE ENTRY DATE: 2019-04-01
  ref <313>: RELEVANT RESIDUES IN SEQ ID NO: (1)..(1557)
tctatggagagtttgatcctggctcaggacgaacgctggcggcgtgcctaatacatgcaagtcgagcggactgatggggagcttgctcccctgacgtcagcggcggacgggtgagtaacacgtgggcaacctgcctcacagactgggataactccgggaaaccggggctaataccggataatcaaaggaaccgcatggttcccttgtaaaagttgggttttacctaacactgtgagatgggcccgcggcgcattagctagttggtgaggtagtggctcaccaaggcgacgatgcgtagccgacctgagagggtgatcggccacactgggactgagacacggcccagactcctacgggaggcagcagtagggaatcatccgcaatggacgaaagtctgacggtgcaacgccgcgtgagtgatgacggtcttcggattgtaaagctctgttgtcagggaagaacaagtgccgttcgaacagggcggcaccttgacggtacctgaccagaaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgagtgtaggagaggaaagtggaattccaagtgtagcggtgaaatgcgtagatatttggaggaacaccagtggcgaaggcgactttctggcctacaactgacgctgaggcgcgaaagcgtggggagcaaacaggattagataccctggtagtccacgccgtaaacgatgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggcagcaaagccgcgaggccgagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgcggtaaccttttggagccagccgccgaaggtgggacagatgattggggtgaagtcgtaacaaggtatccctaccggaaggtggggatggatcacctcctttcta

SEQ ID NO: 271 - DNA, 883 bp, Bacillus sp. KbaB1
  ref <308>: DATABASE ACCESSION NUMBER: NCBI ACCESSION: NZ_NELX01000009.1
  ref <309>: DATABASE ENTRY DATE: 2019-04-01
  ref <313>: RELEVANT RESIDUES IN SEQ ID NO: (1)..(883)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcatta

SEQ ID NO: 272 - DNA, 1556 bp, Bacillus sp. KbaL1; identical to SEQ ID NO: 185
  ref <308>: DATABASE ACCESSION NUMBER: NCBI ACCESSION: NZ_NELW01000048.1
  ref <309>: DATABASE ENTRY DATE: 2019-04-01
  ref <313>: RELEVANT RESIDUES IN SEQ ID NO: (1)..(1556)

SEQ ID NO: 273 - DNA, 462 bp, Bacillus sp. L75
  misc_feature (457)..(457): n is a, c, g, or t
  ref <308>: DATABASE ACCESSION NUMBER: NCBI ACCESSION: NZ_ML064934.1
  ref <309>: DATABASE ENTRY DATE: 2019-04-01
  ref <313>: RELEVANT RESIDUES IN SEQ ID NO: (1)..(462)
taggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtngcacg

SEQ ID NO: 274 - DNA, 1377 bp, Bacillus sp. LB 2018; identical to SEQ ID NO: 220
  ref <308>: DATABASE ACCESSION NUMBER: NCBI ACCESSION: NZ_QUQU01000032.1
  ref <309>: DATABASE ENTRY DATE: 2019-04-01
  ref <313>: RELEVANT RESIDUES IN SEQ ID NO: (1)..(1377)

SEQ ID NO: 275 - DNA, 1555 bp, Bacillus sp. LF1
  ref <308>: DATABASE ACCESSION NUMBER: NCBI ACCESSION: NZ_CVRB01000005.1
  ref <309>: DATABASE ENTRY DATE: 2019-04-01
  ref <313>: RELEVANT RESIDUES IN SEQ ID NO: (1)..(1555)
tttcttggagagtttgatcctggctcaggacgaacgctggcggcgtgcctaatacatgcaagtcgagcgaatcaataggagcttgctcctgttggttagcggcggacgggtgagtaacacgtgggcaacctgcctgtaagactgggataacttcgggaaaccggagctaataccggataatccttttcctcacatgagggagagctgaaagacggtttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgccactcctagagataggacgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 276 - DNA, 1551 bp, Bacillus sp. LLTC93
  ref <308>: DATABASE ACCESSION NUMBER: NCBI ACCESSION: NZ_PVME01000016.1
  ref <309>: DATABASE ENTRY DATE: 2019-04-01
  ref <313>: RELEVANT RESIDUES IN SEQ ID NO: (1)..(1551)
ttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagcgaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttct

SEQ ID NO: 277 - DNA, 1548 bp, Bacillus sp. LNXM10; identical to SEQ ID NO: 231
  ref <308>: DATABASE ACCESSION NUMBER: NCBI ACCESSION: NZ_PVRD01000014.1
  ref <309>: DATABASE ENTRY DATE: 2019-04-01
  ref <313>: RELEVANT RESIDUES IN SEQ ID NO: (1)..(1548)

SEQ ID NO: 278 - DNA, 1548 bp, Bacillus sp. LNXM12-1; identical to SEQ ID NO: 231
  ref <308>: DATABASE ACCESSION NUMBER: NCBI ACCESSION: NZ_PVWX01000009.1
  ref <309>: DATABASE ENTRY DATE: 2019-04-01
  ref <313>: RELEVANT RESIDUES IN SEQ ID NO: (1)..(1548)

SEQ ID NO: 279 - DNA, 1548 bp, Bacillus sp. LNXM12-2
  ref <308>: DATABASE ACCESSION NUMBER: NCBI ACCESSION: NZ_PVWY01000010.1
  ref <309>: DATABASE ENTRY DATE: 2019-04-01
  ref <313>: RELEVANT RESIDUES IN SEQ ID NO: (1)..(1548)
tcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcagtgaaatgcgtagagatgtggaggaataccgatggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttct

SEQ ID NO: 280 - DNA, 1548 bp, Bacillus sp. LNXM65; identical to SEQ ID NO: 231
  ref <308>: DATABASE ACCESSION NUMBER: NCBI ACCESSION: NZ_PVRB01000016.1
  ref <309>: DATABASE ENTRY DATE: 2019-04-01
  ref <313>: RELEVANT RESIDUES IN SEQ ID NO: (1)..(1548)

SEQ ID NO: 281 - DNA, 1370 bp, Bacillus sp. LYLB4
  ref <308>: DATABASE ACCESSION NUMBER: NCBI ACCESSION: NZ_NBBC01000018.1
  ref <309>: DATABASE ENTRY DATE: 2019-04-01
  ref <313>: RELEVANT RESIDUES IN SEQ ID NO: (1)..(1370)
tgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaa

SEQ ID NO: 282 - DNA, 1553 bp, Bacillus sp. Lzh-5
  ref <308>: DATABASE ACCESSION NUMBER: NCBI ACCESSION: NZ_CP024647.1
  ref <309>: DATABASE ENTRY DATE: 2019-04-01
  ref <313>: RELEVANT RESIDUES IN SEQ ID NO: (1)..(1553)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttct

SEQ ID NO: 283 - DNA, 1556 bp, Bacillus sp. M13 2017
  ref <308>: DATABASE ACCESSION NUMBER: NCBI ACCESSION: NZ_KZ268529.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataatattttgaactgcatggttcgaaattgaaaggcggcttcggctgtcacttatggatgggcccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 284 - DNA, 1484 bp, Bacillus sp. M21
  ref <308>: DATABASE ACCESSION NUMBER: NCBI ACCESSION: NZ_PVNJ01000059.1
  ref <309>: DATABASE ENTRY DATE: 2019-04-01
  ref <313>: RELEVANT RESIDUES IN SEQ ID NO: (1)..(1484)
ggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 285 - DNA, 1554 bp, Bacillus sp. M5HDSG1-1
  ref <308>: DATABASE ACCESSION NUMBER: NCBI ACCESSION: NZ_RZTZ01000049.1
  ref <309>: DATABASE ENTRY DATE: 2019-04-01
  ref <313>: RELEVANT RESIDUES IN SEQ ID NO: (1)..(1554)
tttatcggagagtttgatcctggctcaggacgaacgctggcggcgtgcctaatacatgcaagtcgagcggacttaaaaagcttgctttttaagttagcggcggacgggtgagtaacacgtgggcaacctgcctgtaagactgggataacttcgggaaaccggagctaataccggataatcctttcctactcatgtaggaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcctaaggtgggatagatgattggggtgaagtcgtaacaaggtagccgtatcggaaggtgcggctggatcacctcctttcta

SEQ ID NO: 286 - DNA, 1550 bp, Bacillus sp. M6-12
  ref <308>: DATABASE ACCESSION NUMBER: NCBI ACCESSION: NZ_PGVF01000032.1
  ref <309>: DATABASE ENTRY DATE: 2019-04-01
  ref <313>: RELEVANT RESIDUES IN SEQ ID NO: (1)..(1550)
tcggagagtttgatcctggctcaggacgaacgctggcggcgtgcctaatacatgcaagtcgagcggacttgatggagcttgctcctgatagtcagcggcggacgggtgagtaacacgtgggcaacctgcctgtaagactgggataacttcgggaaaccggagctaataccggatacgttcttttctcgcatgagagaagatggaaagacggtttcggctgtcacttacagatgggcccgcggcgcattagctagttggtggggtaatggcccaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacaagtaccatagtaactgatggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgtttcccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacccgcgagggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttcta

SEQ ID NO: 287 - DNA, 1357 bp, Bacillus sp. MB353a
  ref <308>: DATABASE ACCESSION NUMBER: NCBI ACCESSION: NZ_NEOT01000164.1
  ref <309>: DATABASE ENTRY DATE: 2019-04-01
  ref <313>: RELEVANT RESIDUES IN SEQ ID NO: (1)..(1357)
aaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttctatgga

SEQ ID NO: 288 - DNA, 1269 bp, Bacillus sp. MBGLi97
  ref <308>: DATABASE ACCESSION NUMBER: NCBI ACCESSION: NZ_PQCL01000040.1
  ref <309>: DATABASE ENTRY DATE: 2019-04-01
  ref <313>: RELEVANT RESIDUES IN SEQ ID NO: (1)..(1269)
acgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 289 - DNA, 1556 bp, Bacillus sp. MD-5; identical to SEQ ID NO: 267
  ref <308>: DATABASE ACCESSION NUMBER: NCBI ACCESSION: NZ_CP021911.1
  ref <309>: DATABASE ENTRY DATE: 2019-04-01
  ref <313>: RELEVANT RESIDUES IN SEQ ID NO: (1)..(1556)

SEQ ID NO: 290 - DNA, 1553 bp, Bacillus sp. MT
  ref <308>: DATABASE ACCESSION NUMBER: NCBI ACCESSION: NZ_QUQT01000016.1
  ref <309>: DATABASE ENTRY DATE: 2019-04-01
  ref <313>: RELEVANT RESIDUES IN SEQ ID NO: (1)..(1553)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 291 - DNA, 1556 bp, Bacillus sp. MYb209
  ref <308>: DATABASE ACCESSION NUMBER: NCBI ACCESSION: NZ_PCNZ01000115.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctacccataagactgggataactccgggaaaccggggctaataccggataatattttgaactgcatagttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaactctagagatagagcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 292 - DNA, 1556 bp, Bacillus sp. MYb56; identical to SEQ ID NO: 234
  ref <308>: DATABASE ACCESSION NUMBER: NCBI ACCESSION: NZ_PCOH01000118.1
  ref <309>: DATABASE ENTRY DATE: 2019-04-01
  ref <313>: RELEVANT RESIDUES IN SEQ ID NO: (1)..(1556)

SEQ ID NO: 293 - DNA, 1339 bp, Bacillus sp. MYb78
  ref <308>: DATABASE ACCESSION NUMBER: NCBI ACCESSION: NZ_PCOB01000076.1
  ref <309>: DATABASE ENTRY DATE: 2019-04-01
  ref <313>: RELEVANT RESIDUES IN SEQ ID NO: (1)..(1339)
ggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttctatgga

SEQ ID NO: 294 - DNA, 1548 bp, Bacillus sp. MZGC1; identical to SEQ ID NO: 231
  ref <308>: DATABASE ACCESSION NUMBER: NCBI ACCESSION: NZ_PVRE01000014.1
  ref <309>: DATABASE ENTRY DATE: 2019-04-01
  ref <313>: RELEVANT RESIDUES IN SEQ ID NO: (1)..(1548)

SEQ ID NO: 295 - DNA, 1689 bp, Bacillus sp. Marseille-P3661
  misc_feature (324)..(324): n is a, c, g, or t
  ref <308>: DATABASE ACCESSION NUMBER: NCBI ACCESSION: NZ_LT965954.1
  ref <309>: DATABASE ENTRY DATE: 2019-04-01
  ref <313>: RELEVANT RESIDUES IN SEQ ID NO: (1)..(1689)
ttttcggagagtttgatcctggctcaggacgaacgctggcggcgtgcctaatacatgcaagtcgagcggatgatgaggagcttgctcctctgattcagcggcggacgggtgagtaacacgtgggcaacctgcctgtaagactgggataacttcgggaaaccggagctaataccggataatctcttaaaccacatggtttaagaataaaagatggtttcggctatcacttacagatgggcccgcggcgcattagctagttggtgaggtaacggctcaccaaggcgacgatgcgtagccgacctgagagggtgatcggccacactnaaccacatggtttaagaataaaagatggtttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacacgtaccagttaactgctggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgctacttctagagatagaaggttccccttcgggggacagagtgacaggtggtgcatggttgtcgtcagctcgtgtcgtgagatgttgggttaagtcccgcaacgagcgcaacccttgtccttagttgccagcattcagttgggcactctaaggagactgccggtgacaaaccggaggaaggtggggatgacgtcaaatcatcatgccccttatgacctgggctacacacgtgctacaatggatggtacaaagggttgcgagaccgcgaggttgagccaatcccataaagccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttct

SEQ ID NO: 296 - DNA, 1369 bp, Bacillus sp. Marseille-P3800
  ref <308>: DATABASE ACCESSION NUMBER: NCBI ACCESSION: NZ_FZLP01000013.1
  ref <309>: DATABASE ENTRY DATE: 2019-04-01
  ref <313>: RELEVANT RESIDUES IN SEQ ID NO: (1)..(1369)
gagaatcgcctgattttcttttgaaagacggcgtctagctgtcactaagggatggacctgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgtgagggaagaacaagtgccggcgtaactaccggcaccttgacggtacctcaccagaaagccacggctaactacgtgccagcagccgcggtaatacgtaggtggcaagcgttgtccggaattattgggcgtaaagcgcgcgcaggcggcttcttaagtctgatgtgaaatctcggggctcaaccccgagcggccattggaaactggggagcttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagtaaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggacgacgtcaaatcatcatgccccttatgacctgggctacacacgtgctacaatggatggtacaaagggcagcgaagccgtgaggtggagccaatcccataaagccattctcagttcggattgcaggctgcaactcgcctgcatgaagccggaattgctagtaatcgcggatcagcatgccgcggtgaatacgttcccgggtcttgtacacaccgcccgtcacaccacgagagtttgtaacacccgaagtcggtgaggtaaccttttggagccagccgcctaaggtgggacaaatgattggggtgaagtcgtaacaaggtagccgtatcggaaggtgcggctggatcacctcctttcta

SEQ ID NO: 297 - DNA, 1334 bp, Bacillus sp. NFR08
  ref <308>: DATABASE ACCESSION NUMBER: NCBI ACCESSION: NZ_QPJG01000018.1
  ref <309>: DATABASE ENTRY DATE: 2019-04-01
  ref <313>: RELEVANT RESIDUES IN SEQ ID NO: (1)..(1334)
gctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtgctagttgaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttcta

SEQ ID NO: 298 - DNA, 1483 bp, Bacillus sp. NMCC4
  ref <308>: DATABASE ACCESSION NUMBER: NCBI ACCESSION: NZ_PVRA01000018.1
  ref <309>: DATABASE ENTRY DATE: 2019-04-01
  ref <313>: RELEVANT RESIDUES IN SEQ ID NO: (1)..(1483)
acagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttcta

SEQ ID NO: 299 - DNA, 1548 bp, Bacillus sp. NMCC46; identical to SEQ ID NO: 231
  ref <308>: DATABASE ACCESSION NUMBER: NCBI ACCESSION: NZ_PVQZ01000013.1
  ref <309>: DATABASE ENTRY DATE: 2019-04-01
  ref <313>: RELEVANT RESIDUES IN SEQ ID NO: (1)..(1548)

SEQ ID NO: 300 - DNA, 1399 bp, Bacillus sp. NMCN1
  ref <308>: DATABASE ACCESSION NUMBER: NCBI ACCESSION: NZ_PVQL01000008.1
  ref <309>: DATABASE ENTRY DATE: 2019-04-01
  ref <313>: RELEVANT RESIDUES IN SEQ ID NO: (1)..(1399)
gggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttcta

SEQ ID NO: 301 - DNA, 1483 bp, Bacillus sp. NMCN6; identical to SEQ ID NO: 298
  ref <308>: DATABASE ACCESSION NUMBER: NCBI ACCESSION: NZ_PVQK01000010.1
  ref <309>: DATABASE ENTRY DATE: 2019-04-01
  ref <313>: RELEVANT RESIDUES IN SEQ ID NO: (1)..(1483)

SEQ ID NO: 302 - DNA, 1548 bp, Bacillus sp. NMTD17; identical to SEQ ID NO: 231
  ref <308>: DATABASE ACCESSION NUMBER: NCBI ACCESSION: NZ_PVRH01000012.1
  ref <309>: DATABASE ENTRY DATE: 2019-04-01
  ref <313>: RELEVANT RESIDUES IN SEQ ID NO: (1)..(1548)

SEQ ID NO: 303 - DNA, 1554 bp, Bacillus sp. NRRL B-14911
  ref <308>: DATABASE ACCESSION NUMBER: NCBI ACCESSION: NZ_CH672363.1
  ref <309>: DATABASE ENTRY DATE: 2019-04-01
  ref <313>: RELEVANT RESIDUES IN SEQ ID NO: (1)..(1554)
ttatatggagagtttgatcctggctcaggacgaacgctggcggcgtgcctaatacatgcaagtcgagcggacggatgggagcttgctccctgaagtcagcggcggacgggtgagtaacacgtgggcaacctgcctgtaagactgggataacttcgggaaaccggagctaataccggataatgcataacctctcatgaggctatgctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccggagtaactgccggcaccttgacggtacctgaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattaggttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 304 - DNA, 1548 bp, Bacillus sp. Nf3
  ref <308>: DATABASE ACCESSION NUMBER: NCBI ACCESSION: NZ_PYUA01000017.1
  ref <309>: DATABASE ENTRY DATE: 2019-04-01
  ref <313>: RELEVANT RESIDUES IN SEQ ID NO: (1)..(1548)
tcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttct

SEQ ID NO: 305 - DNA, 1377 bp, Bacillus sp. OE; identical to SEQ ID NO: 220
  ref <308>: DATABASE ACCESSION NUMBER: NCBI ACCESSION: NZ_QUQQ01000033.1
  ref <309>: DATABASE ENTRY DATE: 2019-04-01
  ref <313>: RELEVANT RESIDUES IN SEQ ID NO: (1)..(1377)

SEQ ID NO: 306 - DNA, 1355 bp, Bacillus sp. OG2
  ref <308>: DATABASE ACCESSION NUMBER: NCBI ACCESSION: NZ_NDFN01000068.1
  ref <309>: DATABASE ENTRY DATE: 2019-04-01
  ref <313>: RELEVANT RESIDUES IN SEQ ID NO: (1)..(1355)
tatgctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccggagtaactgccggcaccttgacggtacctgaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattaggttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 307 - DNA, 1330 bp, Bacillus sp. OK048
  ref <308>: DATABASE ACCESSION NUMBER: NCBI ACCESSION: NZ_FNHN01000041.1
  ref <309>: DATABASE ENTRY DATE: 2019-04-01
  ref <313>: RELEVANT RESIDUES IN SEQ ID NO: (1)..(1330)
cacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgttcttagttgccagcatttagttgggcactctaaggagactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 308 - DNA, 1552 bp, Bacillus sp. OK838
  ref <308>: DATABASE ACCESSION NUMBER: NCBI ACCESSION: NZ_FZPG01000079.1
  ref <309>: DATABASE ENTRY DATE: 2019-04-01
  ref <313>: RELEVANT RESIDUES IN SEQ ID NO: (1)..(1552)
tcggagagtttgatcctggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctttatggagccagccgcctaaggtgggacagatgattggggtgaagtcgtaacaaggtagccgtatcggaaggtgcggctggatcacctcctttctaa

SEQ ID NO: 309 - DNA, 1555 bp, Bacillus sp. OV166
  ref <308>: DATABASE ACCESSION NUMBER: NCBI ACCESSION: NZ_FXWM01000002.1
  ref <309>: DATABASE ENTRY DATE: 2019-04-01
  ref <313>: RELEVANT RESIDUES IN SEQ ID NO: (1)..(1555)
tttcttggagagtttgatcctggctcaggacgaacgctggcggcgtgcctaatacatgcaagtcgagcgaatcaataggagcttgctcctgttggttagcggcggacgggtgagtaacacgtgggcaacctgcctgtaagactgggataacaccgggaaaccggtgctaataccggataatccttttcctctcatgaggaaaagctgaaagacggtttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagctcacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 310 - DNA, 1552 bp, Bacillus sp. OV186
  ref <308>: DATABASE ACCESSION NUMBER: NCBI ACCESSION: NZ_QAXY01000018.1
  ref <309>: DATABASE ENTRY DATE: 2019-04-01
  ref <313>: RELEVANT RESIDUES IN SEQ ID NO: (1)..(1552)
attatggagagtttgatcctggctcaggacgaacgctggcggcgtgcctaatacatgcaagtcgagcggacttgtaggagcttgctcctgcaggttagcggcggacgggtgagtaacacgtgggcaacctacctgtaagactgggataacttcgggaaaccggagctaataccggatgacataaaggaactcctgttcctttattgaaagatggcttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtgctagttaaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggcgttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccagaaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttct

SEQ ID NO: 311 - DNA, 1554 bp, Bacillus sp. OV194
  ref <308>: DATABASE ACCESSION NUMBER: NCBI ACCESSION: NZ_FOML01000023.1
  ref <309>: DATABASE ENTRY DATE: 2019-04-01
  ref <313>: RELEVANT RESIDUES IN SEQ ID NO: (1)..(1554)
tttattggagagtttgatcctggctcaggatgaacgctggcggcgtgcctaatacatgcaagtcgagcggaccaaagagagcttgctctctgaggttagcggcggacgggtgagtaacacgtgggtaacctgcctgtaagacggggataacttcgggaaaccgaagctaataccggatgataaagagaaacgcctgtttcttttttgaaagtcggccttgtgctgacgcttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttcggcaatggacgaaagtctgaccgagcaacgccgcgtgagcgatgaaggccttcgggtcgtaaagctctgttgtcagagaagaacaagtaccggagtaactgccggtaccttgacggtacctgaccagaaagccacggctaactacgtgccagcagccgcggtaatacgtaggtggcaagcgttatccggaattattgggcgtaaagcgcgcgcaggcggttctttaagtctgatgtgaaagcccacggctcaaccgtggagggtcattggaaactggggaacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttggggggttccaccctcagtgctgacgttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctctgaccatcctagagataggactttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatgggtggtacaaagggttgcgaagccgcgaggccgagccaatcccaaaaagccactctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttaggagccagccgccgaaggtgggacagatgattggggtgaagtcgtaacaaggtagccgtatcggaaggtgcggctggatcacctcctttcta

SEQ ID NO: 312 - DNA, 1552 bp, Bacillus sp. OV322
  ref <308>: DATABASE ACCESSION NUMBER: NCBI ACCESSION: NZ_FOMA01000019.1
  ref <309>: DATABASE ENTRY DATE: 2019-04-01
  ref <313>: RELEVANT RESIDUES IN SEQ ID NO: (1)..(1552)
tcggagagtttgatcctggctcaggacgaacgctggcggcgtgcctaatacatgcaagtcgagcgaatggatgggagcttgctccctgaagttagcggcggacgggtgagtaacacgtgggcaacctgcctgtaagactgggataacttcgggaaaccggagctaataccggatacgttctttcctcgcatgaggaaagatggaaagacggtttcggctgtcacttacagatgggcccgcggcgcattagctagttggtgaggtaatggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtgccagagtaactgctggcaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacactgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaagccgcgaggccgagcaaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttctaa

SEQ ID NO: 313 - DNA, 1556 bp, Bacillus sp. OV752; identical to SEQ ID NO: 234
  ref <308>: DATABASE ACCESSION NUMBER: NCBI ACCESSION: NZ_QAYD01000050.1
  ref <309>: DATABASE ENTRY DATE: 2019-04-01
  ref <313>: RELEVANT RESIDUES IN SEQ ID NO: (1)..(1556)

SEQ ID NO: 314 - DNA, 375 bp, Bacillus sp. P14.5
  ref <308>: DATABASE ACCESSION NUMBER: NCBI ACCESSION: NZ_NIJF01000116.1
  ref <309>: DATABASE ENTRY DATE: 2019-04-01
  ref <313>: RELEVANT RESIDUES IN SEQ ID NO: (1)..(375)
tatcggagagtttgatcctggctcaggacgaacgctggcggcgtgcctaatacatgcaagtcgagcggattgatgggagcttgctccctgaaatcagcggcggacgggtgagtaacacgtgggtaacctgcctgtaagactgggataactccgggaaaccggggctaataccggatagttcttttcctcgcatgaggaaaagtggaaaggcggcttcggctgccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttcc

SEQ ID NO: 315 - DNA, 1556 bp, Bacillus sp. PF5; identical to SEQ ID NO: 120
  ref <308>: DATABASE ACCESSION NUMBER: NCBI ACCESSION: NZ_QMGB01000071.1
  ref <309>: DATABASE ENTRY DATE: 2019-04-01
  ref <313>: RELEVANT RESIDUES IN SEQ ID NO: (1)..(1556)

SEQ ID NO: 316 - DNA, 1557 bp, Bacillus sp. PK3 68
  ref <308>: DATABASE ACCESSION NUMBER: NCBI ACCESSION: NZ_NQYC01000001.1
  ref <309>: DATABASE ENTRY DATE: 2019-04-01
  ref <313>: RELEVANT RESIDUES IN SEQ ID NO: (1)..(1557)
tttttggagagtttgatcctggctcaggacgaacgctggcggcgtgcctaatacatgcaagtcgagcggacttgacggagcttgctctgttcaagttagcggcggacgggtgagtaacacgtgggtaacctgcctgtaagactgggataactccgggaaaccggggctaataccggatattctttttcttcgcatgaagaagaatggaaaggcggcttttagctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtaccaaagtaactgttggtaccttgacggtacctgaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtctggagacagatctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcaaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgcctaaggtggggcagatgattggggtgaagtcgtaacaaggtagccgtatcggaaggtgcggctggatcacctcctttcta

SEQ ID NO: 317 - DNA, 1358 bp, Bacillus sp. PS00077A
  ref <308>: DATABASE ACCESSION NUMBER: NCBI ACCESSION: NZ_QVOD01000136.1
  ref <309>: DATABASE ENTRY DATE: 2019-04-01
  ref <313>: RELEVANT RESIDUES IN SEQ ID NO: (1)..(1358)
gaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttctatgga

SEQ ID NO: 318 - DNA, 1551 bp, Bacillus sp. RC; identical to SEQ ID NO: 128
  ref <308>: DATABASE ACCESSION NUMBER: NCBI ACCESSION: NZ_QUQS01000040.1
  ref <309>: DATABASE ENTRY DATE: 2019-04-01
  ref <313>: RELEVANT RESIDUES IN SEQ ID NO: (1)..(1551)

SEQ ID NO: 319 - DNA, 1551 bp, Bacillus sp. RJGP41
  ref <308>: DATABASE ACCESSION NUMBER: NCBI ACCESSION: NZ_PVQJ01000049.1
  ref <309>: DATABASE ENTRY DATE: 2019-04-01
  ref <313>: RELEVANT RESIDUES IN SEQ ID NO: (1)..(1551)
tcggagagtttgatcctggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctttcta

SEQ ID NO: 320 - DNA, 1483 bp, Bacillus sp. RP1137
  ref <308>: DATABASE ACCESSION NUMBER: NCBI ACCESSION: NZ_AXZS01000024.1
  ref <309>: DATABASE ENTRY DATE: 2019-04-01
  ref <313>: RELEVANT RESIDUES IN SEQ ID NO: (1)..(1483)
gattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttcta

SEQ ID NO: 321 - DNA, 1550 bp, Bacillus sp. RU27A
  ref <308>: DATABASE ACCESSION NUMBER: NCBI ACCESSION: NZ_FZOE01000037.1
  ref <309>: DATABASE ENTRY DATE: 2019-04-01
  ref <313>: RELEVANT RESIDUES IN SEQ ID NO: (1)..(1550)
tcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 322 - DNA, 1555 bp, Bacillus sp. Rc4
  ref <308>: DATABASE ACCESSION NUMBER: NCBI ACCESSION: NZ_PZKP01000050.1
  ref <309>: DATABASE ENTRY DATE: 2019-04-01
  ref <313>: RELEVANT RESIDUES IN SEQ ID NO: (1)..(1555)
tttatcggagagtttgatcctggctcaggacgaacgctggccggcgtgcctaatacagcaagtcgagcggacagatgggagcttgctccctgatggttagcggcggacgggtgagtaacacgtgggtaacctgcctgtaagactgggataactccgggaaaccggggctaataccggatggttatttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 323 - DNA, 859 bp, Bacillus sp. Ru63
  ref <308>: DATABASE ACCESSION NUMBER: NCBI ACCESSION: NZ_PQST01000068.1
  ref <309>: DATABASE ENTRY DATE: 2019-04-01
  ref <313>: RELEVANT RESIDUES IN SEQ ID NO: (1)..(859)
acgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcatt

SEQ ID NO: 324 - DNA, 1253 bp, Bacillus sp. S1-R2T1-FB
  ref <308>: DATABASE ACCESSION NUMBER: NCBI ACCESSION: NZ_NBNU01000035.1
  ref <309>: DATABASE ENTRY DATE: 2019-04-01
  ref <313>: RELEVANT RESIDUES IN SEQ ID NO: (1)..(1253)
gagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttctatgga

SEQ ID NO: 325 - DNA, 1556 bp, Bacillus sp. S1-R4H1-FB; identical to SEQ ID NO: 204
  ref <308>: DATABASE ACCESSION NUMBER: NCBI ACCESSION: NZ_NBNT01000115.1
  ref <309>: DATABASE ENTRY DATE: 2019-04-01
  ref <313>: RELEVANT RESIDUES IN SEQ ID NO: (1)..(1556)

SEQ ID NO: 326 - DNA, 1459 bp, Bacillus sp. S1-R5C1-FB
  ref <308>: DATABASE ACCESSION NUMBER: NCBI ACCESSION: NZ_NBNS01000051.1
  ref <309>: DATABASE ENTRY DATE: 2019-04-01
  ref <313>: RELEVANT RESIDUES IN SEQ ID NO: (1)..(1459)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacc

SEQ ID NO: 327 - DNA, 614 bp, Bacillus sp. S2-R3J1-FB-BA1
  ref <308>: DATABASE ACCESSION NUMBER: NCBI ACCESSION: NZ_NBNR01000036.1
  ref <309>: DATABASE ENTRY DATE: 2019-04-01
  ref <313>: RELEVANT RESIDUES IN SEQ ID NO: (1)..(614)
caagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttctatgga

SEQ ID NO: 328 - DNA, 1555 bp, Bacillus sp. S66; identical to SEQ ID NO: 259
  ref <308>: DATABASE ACCESSION NUMBER: NCBI ACCESSION: NZ_RBAJ01000037.1
  ref <309>: DATABASE ENTRY DATE: 2019-04-01
  ref <313>: RELEVANT RESIDUES IN SEQ ID NO: (1)..(1555)

SEQ ID NO: 329 - DNA, 1542 bp, Bacillus sp. SA5d-4
  ref <308>: DATABASE ACCESSION NUMBER: NCBI ACCESSION: NZ_NPIA01000019.1
  ref <309>: DATABASE ENTRY DATE: 2019-04-01
  ref <313>: RELEVANT RESIDUES IN SEQ ID NO: (1)..(1542)
ttatggagagtttgatcctggctcaggacgaacgctggcggcgtgcctaatacatgcaagtcgagcggaccacttcggtggtcagcggcgaacgggtgagtaacacgtgggcaacctgccctgcagactgggataacttcgggaaaccggagctaataccggataatcgatcacatcgcatgatgtgattatgaaagttgggttttacctaacactgcaggatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggaaacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgtcggggggtaccaccctcggtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttcgctatccctagagatagggagttccccttcgggggacgaagtgacaggtggtgcatggttgtcgtcagctcgtgtcgtgagatgttgggttaagtcccgcaacgagcgcaacccttgaccttagttgccagcattaagttgggcactctaaggtgactgccggtgacaaaccggaggaaggtggggatgacgtcaaatcatcatgccccttatgacctgggctacacacgtgctacaatggatgatacaaagagcagcgagaccgcgaggttaagcgaatctcataaagtcattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaacccttacgggagccagccgcctaaggtgggacagatgattggggtgaagtcgtaacaaggtagccgtatcggaaggtgcggctggatcacctcctttcta

SEQ ID NO: 330 - DNA, 994 bp, Bacillus sp. SAJ1
  ref <308>: DATABASE ACCESSION NUMBER: NCBI ACCESSION: NZ_RYEN01000175.1
  ref <309>: DATABASE ENTRY DATE: 2019-04-01
  ref <313>: RELEVANT RESIDUES IN SEQ ID NO: (1)..(994)
tccggaattattgggcgtaaagcgcgcgcaggcggtttcttaagtctgatgtgaaagcccacggctcaaccgtggagggtcattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttcta

SEQ ID NO: 331 - DNA, 1553 bp, Bacillus sp. SJ-10
  ref <308>: DATABASE ACCESSION NUMBER: NCBI ACCESSION: NZ_CP025258.1
  ref <309>: DATABASE ENTRY DATE: 2019-04-01
  ref <313>: RELEVANT RESIDUES IN SEQ ID NO: (1)..(1553)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcaaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttct

SEQ ID NO: 332 - DNA, 1458 bp, Bacillus sp. SKP7-4
  ref <308>: DATABASE ACCESSION NUMBER: NCBI ACCESSION: NZ_QXIR01000081.1
  ref <309>: DATABASE ENTRY DATE: 2019-04-01
  ref <313>: RELEVANT RESIDUES IN SEQ ID NO: (1)..(1458)
agcggcggacgggtgagtaacacgtgggtaacctgcctgtaagactgggataactccgggaaaccggggctaataccggatagttcctttcctcacatggggaagggtggaaaggcggcttcggctgccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaataggtcggcaccttgacggtacctaaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggggacttgagtgcagaagaggaaagtggaattccacgtgtagcggtgaaatgcgtagatatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggacggtacaaagggcagcaagaccgcgaggtttagcaaatcccataaaaccgttctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 333 - DNA, 1350 bp, Bacillus sp. SN1
  ref <308>: DATABASE ACCESSION NUMBER: NCBI ACCESSION: NZ_PHIE01000012.1
  ref <309>: DATABASE ENTRY DATE: 2019-04-01
  ref <313>: RELEVANT RESIDUES IN SEQ ID NO: (1)..(1350)
ataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 334 - DNA, 840 bp, Bacillus sp. SN10
  ref <308>: DATABASE ACCESSION NUMBER: NCBI ACCESSION: NZ_PJCU01000049.1
  ref <309>: DATABASE ENTRY DATE: 2019-04-01
  ref <313>: RELEVANT RESIDUES IN SEQ ID NO: (1)..(840)
aagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaacc

SEQ ID NO: 335 - DNA, 1553 bp, Bacillus sp. SN32; identical to SEQ ID NO: 290
  ref <308>: DATABASE ACCESSION NUMBER: NCBI ACCESSION: NZ_PJCT01000014.1
  ref <309>: DATABASE ENTRY DATE: 2019-04-01
  ref <313>: RELEVANT RESIDUES IN SEQ ID NO: (1)..(1553)

SEQ ID NO: 336 - DNA, 1556 bp, Bacillus sp. SRB 28; identical to SEQ ID NO: 234
  ref <308>: DATABASE ACCESSION NUMBER: NCBI ACCESSION: NZ_NADU01000024.1
  ref <309>: DATABASE ENTRY DATE: 2019-04-01
  ref <313>: RELEVANT RESIDUES IN SEQ ID NO: (1)..(1556)

SEQ ID NO: 337 - DNA, 1556 bp, Bacillus sp. SRB 331; identical to SEQ ID NO: 234
  ref <308>: DATABASE ACCESSION NUMBER: NCBI ACCESSION: NZ_NADV01000014.1
  ref <309>: DATABASE ENTRY DATE: 2019-04-01
  ref <313>: RELEVANT RESIDUES IN SEQ ID NO: (1)..(1556)

SEQ ID NO: 338 - DNA, 1546 bp, Bacillus sp. SRB 336
  ref <308>: DATABASE ACCESSION NUMBER: NCBI ACCESSION: NZ_NADW01000020.1
  ref <309>: DATABASE ENTRY DATE: 2019-04-01
  ref <313>: RELEVANT RESIDUES IN SEQ ID NO: (1)..(1546)
taagtgaagagtttgatcctggctcagattgaacgctggcggcatgcctaacacatgcaagtcgaacggcagcacagaggagcttgctccttgggtggcgagtggcggacgggtgagtaatgcatcgggatctacctcaacgtgggggataacgtagggaaacttacgctaataccgcatacgtcctaagggagaaagcgggggaccgtaaggcctcgcgcggtgagacgaaccgatgttcgattagctagttggtagggtaatggcctaccaaggcgacgatcgatagctggtctgagaggatgatcagccacactggaactgagacacggtccagactcctacgggaggcagcagtggggaatattggacaatgggcgcaagcctgatccagcaatgccgcgtgtgtgaagaaggccttcgggttgtaaagcacttttatcaggaacgaaataccacgggttaataacctatggggctgacggtacctgaggaataagcaccggctaacttcgtgccagcagccgcggtaatacgaagggtgcaagcgttaatcggaattactgggcgtaaagggtgcgtaggcggttgtttaagtctgtcgtgaaatccccgggctcaacctgggaatggcgatggatactggacagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcaataccgcgaggtggagccaatcccagaaagccgatcccagtccggatcggagtctgcaactcgactccgtgaagtcggaatcgctagtaatcgcggatcagctatgccgcggtgaatacgttcccgggccttgtacacaccgcccgtcacaccatgggagtgggttgctccagaaggcgttagtctaaccgcaagggggacgacgcccacggagtggtccatgactggggtgaagtcgtaacaaggtagccgtatcggaaggtgcggctggatcacctcctttc

SEQ ID NO: 339 - DNA, 1556 bp, Bacillus sp. SRB 8; identical to SEQ ID NO: 234
  ref <308>: DATABASE ACCESSION NUMBER: NCBI ACCESSION: NZ_NADT01000071.1
  ref <309>: DATABASE ENTRY DATE: 2019-04-01
  ref <313>: RELEVANT RESIDUES IN SEQ ID NO: (1)..(1556)

SEQ ID NO: 340 - DNA, 1392 bp, Bacillus sp. STP3
  ref <308>: DATABASE ACCESSION NUMBER: NCBI ACCESSION: NZ_QYZC01000026.1
  ref <309>: DATABASE ENTRY DATE: 2019-04-01
  ref <313>: RELEVANT RESIDUES IN SEQ ID NO: (1)..(1392)
ggggctaataccggatggttgtttgaaccgcatggttcagacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 341 - DNA, 1165 bp, Bacillus sp. SUBG0010
  ref <308>: DATABASE ACCESSION NUMBER: NCBI ACCESSION: NZ_QGHN01000023.1
  ref <309>: DATABASE ENTRY DATE: 2019-04-01
  ref <313>: RELEVANT RESIDUES IN SEQ ID NO: (1)..(1165)
aagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttcta

SEQ ID NO: 342 - DNA, 1553 bp, Bacillus sp. T33-2
  ref <308>: DATABASE ACCESSION NUMBER: NCBI ACCESSION: NZ_PGVB01000019.1
  ref <309>: DATABASE ENTRY DATE: 2019-04-01
  ref <313>: RELEVANT RESIDUES IN SEQ ID NO: (1)..(1553)
ttattggagagtttgatcctggctcaggacgaacgctggcggcgtgcctaatacatgcaagtcgagcggatcttcggaagcttgcttccgaagattagcggcggacgggtgagtaacacgtgggcaacctgcctgtaagactgggataacttcgggaaaccggagctaataccggataattcctttcccctcatgggggaaggctgaaagacggtttcggctgtcacttacagatgggcccgcggcgcattagctagttggtggggtaacggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtgccggagtaactgccggcaccttgacggtacctggccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccttagagataaggcgttccccttcgggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggcagcgaagccgcgaggtgaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 343 - DNA, 1553 bp, Bacillus sp. TE3
  ref <308>: DATABASE ACCESSION NUMBER: NCBI ACCESSION: NZ_RJVS01000032.1
  ref <309>: DATABASE ENTRY DATE: 2019-04-01
  ref <313>: RELEVANT RESIDUES IN SEQ ID NO: (1)..(1553)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 344 - DNA, 1469 bp, Bacillus sp. UMB0728
  ref <308>: DATABASE ACCESSION NUMBER: NCBI ACCESSION: NZ_PKLA01000016.1
  ref <309>: DATABASE ENTRY DATE: 2019-04-01
  ref <313>: RELEVANT RESIDUES IN SEQ ID NO: (1)..(1469)
ctccctgaagtcagcggcggacgggtgagtaacacgtgggcaacctgcctgtaagactgggataacttcgggaaaccggagctaataccggataatgcacagcctctcatgaggctatgctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccggagtaactgccggcaccttgacggtacctgaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattaggttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 345 - DNA, 1556 bp, Bacillus sp. UMB0899
  ref <308>: DATABASE ACCESSION NUMBER: NCBI ACCESSION: NZ_PNGA01000001.1
  ref <309>: DATABASE ENTRY DATE: 2019-04-01
  ref <313>: RELEVANT RESIDUES IN SEQ ID NO: (1)..(1556)
tttattggagagtttgatcctggctcaggacgaacgctggcggcgtgccttaatacatgcaagtcgagcgaatctgagggagcttgctcccaaagattagcggcggacgggtgagtaacacgtgggtaacctgcctgtaagattgggataactccgggaaaccggagctaataccggataacatttcgaaccgcatggttcgaaattgaaagacggcgtctagctgtcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatccttcgctacttctagagatagaaggttccccttcgggggacgaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagactgcgaagtcaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttcta

SEQ ID NO: 346 - DNA, 227 bp, Bacillus sp. UNCCL13
  ref <308>: DATABASE ACCESSION NUMBER: NCBI ACCESSION: NZ_FOJZ01000017.1
  ref <309>: DATABASE ENTRY DATE: 2019-04-01
  ref <313>: RELEVANT RESIDUES IN SEQ ID NO: (1)..(227)
ctttaacggagagtttgatcctggctcaggacgaacgctggcggcgtgcctaatacatgcaagtcgagcggattgatgggagcttgctccctgatatcagcggcggacgggtgagtaacacgtgggcaacctgcctgtaagactgggataacttcgggaaaccggagctaataccggataatccttttcctctcatgaggaaaagctgaaagacggtttcggctgtc

SEQ ID NO: 347 - DNA, 890 bp, Bacillus sp. UNCCL81
  ref <308>: DATABASE ACCESSION NUMBER: NCBI ACCESSION: NZ_FOMF01000001.1
  ref <309>: DATABASE ENTRY DATE: 2019-04-01
  ref <313>: RELEVANT RESIDUES IN SEQ ID NO: (1)..(890)
tagggaatcttccgcaatggacgaaagtctgacggagcaacgccgcgtgagcgatgaaggccttcgggtcgtaaagctctgttgttagggaagaataagtgctagttgaataagctggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatag

SEQ ID NO: 348 - DNA, 1459 bp, Bacillus sp. V3-13
  ref <308>: DATABASE ACCESSION NUMBER: NCBI ACCESSION: NZ_PGUZ01000095.1
  ref <309>: DATABASE ENTRY DATE: 2019-04-01
  ref <313>: RELEVANT RESIDUES IN SEQ ID NO: (1)..(1459)
tttttggagagtttgatcctggctcaggacgaacgctggcggcgtgcctaatacatgcaagtcgagcggacgaatgggagcttgctccttattcgttagcggcggacgggtgagtaacacgtgggcaacctgcctgtaagactgggataacttcgggaaaccggagctaataccggataatccttttcccctcctggggaaaagctgaaagacggtttcggctgtcacttacagatgggcccgcggcgcattagctggttggtggggtaacggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacaagtaccggagtcactgccggtaccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggaaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgccaatcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcggcgaaaccgcgaggtggagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacct

SEQ ID NO: 349 - DNA, 1454 bp, Bacillus sp. V33-4
  ref <308>: DATABASE ACCESSION NUMBER: NCBI ACCESSION: NZ_PGVC01000067.1
  ref <309>: DATABASE ENTRY DATE: 2019-04-01
  ref <313>: RELEVANT RESIDUES IN SEQ ID NO: (1)..(1454)
tggagagtttgatcctggctcaggacgaacgctggcggcgtgcctaatacatgcaagtcgagcggacgtgcgggagcttgctcccgttcgtcagcggcggacgggtgagtaacacgtgggcaacctgcctgtaagactgggataacttcgggaaaccggagctaataccggataatccattccctcacctgagggaatgctgaaagacggtttcggctgtcacttacagatgggcccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtattggagtaactgccagtaccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggaaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgaaaccgcgaggtggagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacct

SEQ ID NO: 350 - DNA, 1551 bp, Bacillus sp. V44-8
  ref <308>: DATABASE ACCESSION NUMBER: NCBI ACCESSION: NZ_QVTD01000020.1
  ref <309>: DATABASE ENTRY DATE: 2019-04-01
  ref <313>: RELEVANT RESIDUES IN SEQ ID NO: (1)..(1551)
ttcggagagtttgatcctggctcaggacgaacgctggcggcgtgcctaatacatgcaagtcgagcgaacttttggaagcttgcttccgaaagttagcggcggacgggtgagtaacacgtgggcaacctgcctgtaagactgggataacttcgggaaaccggagctaataccggatacattcttcctccacatggaggaagacggaaagacggtttcggctgtcacttacagatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtaccatagtaactgatggtaccttgacggtacctggccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagagtcgcgaacccgcgagggcaagctaatctcataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 351 - DNA, 1552 bp, Bacillus sp. V47-23a
  ref <308>: DATABASE ACCESSION NUMBER: NCBI ACCESSION: NZ_QVTE01000059.1
  ref <309>: DATABASE ENTRY DATE: 2019-04-01
  ref <313>: RELEVANT RESIDUES IN SEQ ID NO: (1)..(1552)
tattggagagtttgatcctggctcaggacgaacgctggcggcgtgcctaatacatgcaagtcgagcggacttgaaggagcttgctcctgatggttagcggcggacgggtgagtaacacgtgggcaacctgcctgtaagactgggataacttcgggaaaccggagctaataccggatacgttcttttctcgcatgagagaagatggaaagacggtttcggctgtcacttacagatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacaagtaccatagtaactgatggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacccgcgagggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttcta

SEQ ID NO: 352 - DNA, 1547 bp, Bacillus sp. V5-8f
  ref <308>: DATABASE ACCESSION NUMBER: NCBI ACCESSION: NZ_PGUW01000011.1
  ref <309>: DATABASE ENTRY DATE: 2019-04-01
  ref <313>: RELEVANT RESIDUES IN SEQ ID NO: (1)..(1547)
ggagagtttgatcctggctcaggacgaacgctggcggcgtgcctaatacatgcaagtcgagcggattttcggaagcttgcttccgaaaattagcggcggacgggtgagtaacacgtgggcaacctgcctgtaagactgggataacttcgggaaaccggagctaataccggatacattcttccctcgcatgagggaagatggaaagacggttttgctgtcacttacagatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtaccatagtaactgatggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagagttgcgaacccgcgagggcaagctaatctcataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccgcaaggagccagccgcctaaggtgggacagatgattggggtgaagtcgtaacaaggtagccgtatcggaaggtgcggctggatcacctcctttcta

SEQ ID NO: 353 - DNA, 1551 bp, Bacillus sp. V59.32a
  ref <308>: DATABASE ACCESSION NUMBER: NCBI ACCESSION: NZ_QVTC01000045.1
  ref <309>: DATABASE ENTRY DATE: 2019-04-01
  ref <313>: RELEVANT RESIDUES IN SEQ ID NO: (1)..(1551)
ttcggagagtttgatcctggctcaggacgaacgctggcggcgtgcctaatacatgcaagtcgagcgaatttcagggagcttgctctctgaagttagcggcggacgggtgagtaacacgtgggcaacctgcctgtaagactgggataacttcgggaaaccggagctaataccggatagattctatcttcacatgaaggaagaaggaaagacggtttacgctgtcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacaagtaccagagtaactgctggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagagtcgcgaacccgcgagggtaagctaatctcataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 354 - DNA, 1443 bp, Bacillus sp. VKPM B-3276
  ref <308>: DATABASE ACCESSION NUMBER: NCBI ACCESSION: NZ_RZHM01000114.1
  ref <309>: DATABASE ENTRY DATE: 2019-04-01
  ref <313>: RELEVANT RESIDUES IN SEQ ID NO: (1)..(1443)
gagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 355 - DNA, 1554 bp, Bacillus sp. VMFN-A1
  ref <308>: DATABASE ACCESSION NUMBER: NCBI ACCESSION: NZ_QGGK01000016.1
  ref <309>: DATABASE ENTRY DATE: 2019-04-01
  ref <313>: RELEVANT RESIDUES IN SEQ ID NO: (1)..(1554)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 356 - DNA, 1455 bp, Bacillus sp. WBUNB001
  ref <308>: DATABASE ACCESSION NUMBER: NCBI ACCESSION: NZ_ANAU01000193.1
  ref <309>: DATABASE ENTRY DATE: 2019-04-01
  ref <313>: RELEVANT RESIDUES IN SEQ ID NO: (1)..(1455)
cggcggacggtgagtaacacgtgggtaacctgcccgataagactgggataamtccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccacaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 357 - DNA, 1555 bp, Bacillus sp. WBUNB004; identical to SEQ ID NO: 63
  ref <308>: DATABASE ACCESSION NUMBER: NCBI ACCESSION: NZ_ANGA01000102.1
  ref <309>: DATABASE ENTRY DATE: 2019-04-01
  ref <313>: RELEVANT RESIDUES IN SEQ ID NO: (1)..(1555)

SEQ ID NO: 358 - DNA, 1554 bp, Bacillus sp. WR11
  ref <308>: DATABASE ACCESSION NUMBER: NCBI ACCESSION: NZ_CP033064.1
  ref <309>: DATABASE ENTRY DATE: 2019-04-01
  ref <313>: RELEVANT RESIDUES IN SEQ ID NO: (1)..(1554)
attatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 359 - DNA, 1555 bp, Bacillus sp. X2 2017
  ref <308>: DATABASE ACCESSION NUMBER: NCBI ACCESSION: NZ_NQJE01000030.1
  ref <309>: DATABASE ENTRY DATE: 2019-04-01
  ref <313>: RELEVANT RESIDUES IN SEQ ID NO: (1)..(1555)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 360 - DNA, 1365 bp, Bacillus sp. XXST-01
  ref <308>: DATABASE ACCESSION NUMBER: NCBI ACCESSION: NZ_RXNT01000049.1
  ref <309>: DATABASE ENTRY DATE: 2019-04-01
  ref <313>: RELEVANT RESIDUES IN SEQ ID NO: (1)..(1365)
actcatgttcgaaagctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgctaaccctagagatagggcgttccccttcgggggacggagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttcta

SEQ ID NO: 361 - DNA, 1551 bp, Bacillus sp. Y-01
  ref <308>: DATABASE ACCESSION NUMBER: NCBI ACCESSION: NZ_CP024794.1
  ref <309>: DATABASE ENTRY DATE: 2019-04-01
  ref <313>: RELEVANT RESIDUES IN SEQ ID NO: (1)..(1551)
tcggagagtttgatcctggctcaggatgaacgctggcggcgtgcctaatacatgcaagtcgagcgaactgattagaagcttgcttctatgaagttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttct

SEQ ID NO: 362 - DNA, 1557 bp, Bacillus sp. Y1
  ref <308>: DATABASE ACCESSION NUMBER: NCBI ACCESSION: NZ_CP030028.1
  ref <309>: DATABASE ENTRY DATE: 2019-04-01
  ref <313>: RELEVANT RESIDUES IN SEQ ID NO: (1)..(1557)
ttattggagagtttgatcctggctcaggacgaacgctggcggcgtgcctaatacatgcaagtcgagcggacttggaggaagcttgcttcctccttgttagcggcggacgggtgagtaacacgtgggcaacctgcctatgagactgggataactccgggaaaccggggctaataccggataattcttttctacacatgtagaaaagctgaaagatggtttcggctatcactcatagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggtggtctcttaagtctgatgtgaaagcccccggctcaaccggggagggtcattggaaactgggagacttgagtgcaggagagaagagtggaattccacgtgtagcggtgaaatgcgtagagatgtggaggaacaccagtggcgaaggcgactctttggcctgtaactgacactgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttttgccttccctagagatagggcgttccccttcgggggacaaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggtggtacaaagggcagcaaaaccgcgaggtcgagccaatcccataaaaccactctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttcta

SEQ ID NO: 363 - DNA, 1548 bp, Bacillus sp. YBWC18; identical to SEQ ID NO: 231
  ref <308>: DATABASE ACCESSION NUMBER: NCBI ACCESSION: NZ_PVRI01000014.1
  ref <309>: DATABASE ENTRY DATE: 2019-04-01
  ref <313>: RELEVANT RESIDUES IN SEQ ID NO: (1)..(1548)

SEQ ID NO: 364 - DNA, 1556 bp, Bacillus sp. YF23
  ref <308>: DATABASE ACCESSION NUMBER: NCBI ACCESSION: NZ_PDJR01000002.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 365 - DNA, 1002 bp, Bacillus sp. YN-1
  ref <308>: DATABASE ACCESSION NUMBER: NCBI ACCESSION: NZ_QGHH01000009.1
  ref <309>: DATABASE ENTRY DATE: 2019-04-01
  ref <313>: RELEVANT RESIDUES IN SEQ ID NO: (1)..(1002)
ttattggagagtttgatcctggctcaggatgaacgctggcggcgtgcctaatacatgcaagtcgagcgaacctttgggagcttgctcccaaaggttagcggcggacgggtgagtaacacgtgggcaacctgcctataagactgggataacttcgggaaaccggagctaataccggataacatatgagaccacatggtctcatattgaaagatggcttttagctatcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtaccgttcgaatagggcggtaccttgacggtacctaaccagaaagccacggctaactacgtgccagcagccgcggtaatacgtaggtggcaagcgttatccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttg

SEQ ID NO: 366 - DNA, 1553 bp, Bacillus sp. YR288
  ref <308>: DATABASE ACCESSION NUMBER: NCBI ACCESSION: NZ_PGEU01000001.1
  ref <309>: DATABASE ENTRY DATE: 2019-04-01
  ref <313>: RELEVANT RESIDUES IN SEQ ID NO: (1)..(1553)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccaaggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggcttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 367 - DNA, 1372 bp, Bacillus sp. YR335
  ref <308>: DATABASE ACCESSION NUMBER: NCBI ACCESSION: NZ_QLLP01000037.1
  ref <309>: DATABASE ENTRY DATE: 2019-04-01
  ref <313>: RELEVANT RESIDUES IN SEQ ID NO: (1)..(1372)
attttgaaccgcatggttcaaaattgaaagatggtttcggctatcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccactgcccggtatagagatatacctttcccttcggggacagtggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcgagactgcgaagtcaagccaatcccataaaaccattctcagttcggattgcaggctgcaactcgcctgcatgaagctggaatcgctagtaatcgtggatcagcatgccacggtgaatacgttcccgggccttgtacacaccgcccgtcacaccacgagagtttgtaacacccgaagccggtggggtaaccgtaaggagccagccgtctaaggtgggacagatgattggggtgaagtcgtaacaaggtagccgtatcggaaggtgcggctggatcacctcctttct

SEQ ID NO: 368 - DNA, 1555 bp, Bacillus sp. YSP-3
  ref <308>: DATABASE ACCESSION NUMBER: NCBI ACCESSION: NZ_PDOF01000008.1
  ref <309>: DATABASE ENTRY DATE: 2019-04-01
  ref <313>: RELEVANT RESIDUES IN SEQ ID NO: (1)..(1555)
tacggagagtttgatcctggctcaggacgaacgctggcggcgtgcctaatacatgcaagtcgagcggactgatggggagcttgctcccctgacgtcagcggcggacgggtgagtaacacgtgggcaacctgcctcacagactgggataactccgggaaaccggggctaataccggataatcaaaggaaccgcatggttcccttgtaaaagttgggttttacctaacactgtgagatgggcccgcggcgcattagcttgttggtgaggtagtggctcaccaaggcgacgatgcgtagccgacctgagagggtgatcggccacactgggactgagacacggcccagactcctacgggaggcagcagtagggaatcatccgcaatgggcgaaagcctgacggtgcaacgccgcgtgagtgatgacggtcttcggattgtaaagctctgttgtcagggaagaacaagtgccgtgcgaatagagcggcaccttgacggtacctgaccagaaagccccggctaactacgtgccagcagccgcggtaatacgtagggggcaagcgttgtccggaattattgggcgtaaagcgcgcgcaggcggttctttaagtctgatgtgaaagcccacggctcaaccgtggagggtcattggaaactggggaacttgagtgtaggagaggaaagtggaataccaagtgtagcggtgaaatgcgtagatatttggtggaacaccagtggcgaaggcgactttctggcctacaactgacgctgaggcgcgaaagcgtggggagcaaacaggattagataccctggtagtccacgccgtaaacgatgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgaccttagttgccagcatttagttgggcactctaaggtgactgccggtgacaaaccggaggaaggtggggacgacgtcaaatcatcatgccccttatgacctgggctacacacgtgctacaatggatggtacaaagggcagcaaaaccgcgaggttgagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagcttgtaacacccgaagtcggtgcggtaaccttttggagccagccgccgaaggtgggacaggtgattggggtgaagtcgtaacaaggtatccctaccggaaggtggggatggatcacctcctttcta

SEQ ID NO: 369 - DNA, 1557 bp, Bacillus sp. ZY-1-1
  ref <308>: DATABASE ACCESSION NUMBER: NCBI ACCESSION: NZ_CP027061.1
  ref <309>: DATABASE ENTRY DATE: 2019-04-01
  ref <313>: RELEVANT RESIDUES IN SEQ ID NO: (1)..(1557)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccgggaattattgggcgtaaagggctcgcaggcggtttcttaagtctgatgtgaaagcccccggctcaaccggggagggtcattggaaactggggaacttgagtgcagaagaggagagtggaattccacgttgtagcggtgaaatgcgtagagatgtggaggaacaccagtggcgaaggcgactctctggtctgtaactgacgctgaggagcgaaagcgtggggagcgaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggttttaattcgaagcaacgcgaagaaccttaccaggtcttgacatcctctgacaatcctagagataggacgtctccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttct

SEQ ID NO: 370 - DNA, 273 bp, Bacillus sp. cl115
  ref <308>: DATABASE ACCESSION NUMBER: NCBI ACCESSION: NZ_FNQU01000009.1
  ref <309>: DATABASE ENTRY DATE: 2019-04-01
  ref <313>: RELEVANT RESIDUES IN SEQ ID NO: (1)..(273)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaac

SEQ ID NO: 371 - DNA, 256 bp, Bacillus sp. cl95
  ref <308>: DATABASE ACCESSION NUMBER: NCBI ACCESSION: NZ_FOYF01000015.1
  ref <309>: DATABASE ENTRY DATE: 2019-04-01
  ref <313>: RELEVANT RESIDUES IN SEQ ID NO: (1)..(256)
ctttaacggagagtttgatcctggctcaggacgaacgctggcggcgtgcctaatacatgcaagtcgagcggattgatgggagcttgctccctgatatcagcggcggacgggtgagtaacacgtgggcaacctgcctgtaagactgggataacttcgggaaaccggagctaataccggataatccttttcctctcatgaggaaaagctgaaagacggtttcggctgtcacttacagatgggcccgcggcgcattagc

SEQ ID NO: 372 - DNA, 278 bp, Bacillus sp. cl96
  ref <308>: DATABASE ACCESSION NUMBER: NCBI ACCESSION: NZ_FNDM01000028.1
  ref <309>: DATABASE ENTRY DATE: 2019-04-01
  ref <313>: RELEVANT RESIDUES IN SEQ ID NO: (1)..(278)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctc

SEQ ID NO: 373 - DNA, 1377 bp, Bacillus sp. dmp10; identical to SEQ ID NO: 220
  ref <308>: DATABASE ACCESSION NUMBER: NCBI ACCESSION: NZ_QUQR01000035.1
  ref <309>: DATABASE ENTRY DATE: 2019-04-01
  ref <313>: RELEVANT RESIDUES IN SEQ ID NO: (1)..(1377)

SEQ ID NO: 374 - DNA, 1367 bp, Bacillus sp. dmp5
  ref <308>: DATABASE ACCESSION NUMBER: NCBI ACCESSION: NZ_QUQZ01000038.1
  ref <309>: DATABASE ENTRY DATE: 2019-04-01
  ref <313>: RELEVANT RESIDUES IN SEQ ID NO: (1)..(1367)
gcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttctatgga

SEQ ID NO: 375 - DNA, 1557 bp, Bacillus sp. es.034
  ref <308>: DATABASE ACCESSION NUMBER: NCBI ACCESSION: NZ_PDIY01000001.1
  ref <309>: DATABASE ENTRY DATE: 2019-04-01
  ref <313>: RELEVANT RESIDUES IN SEQ ID NO: (1)..(1557)
tttatcggagagtttgatcctggctcaggacgaacgctggcggcgtgcctaatacatgcaagtcgagcggattgatgggagcttgctccctgatatcagcggcggacgggtgagtaacacgtgggtaacctgcctgtaagactgggataactccgggaaaccggggctaataccggataactcatttccttgcatgaggaaatgttgaaaggtggcttttagctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggcaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggacggtacaaagggcagcgagaccgcgaggtttagccaatcccataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaa

SEQ ID NO: 376 - DNA, 1557 bp, Bacillus sp. es.036
  ref <308>: DATABASE ACCESSION NUMBER: NCBI ACCESSION: NZ_PDIZ01000001.1
  ref <309>: DATABASE ENTRY DATE: 2019-04-01
  ref <313>: RELEVANT RESIDUES IN SEQ ID NO: (1)..(1557)
tctatcggagagtttgatcctggctcaggacgaacgctggcggcgtgcctaatacatgcaagtcgagcgaagagatgggagcttgctccctgatcttagcggcggacgggtgagtaacacgtgggcaacctgccctgcagactgggataactccgggaaaccggagctaataccgggtaatacatcgcaccgcatggtgcaatgttgaaagttggctttctgagctaacactgcaggatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggccttcgggtcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaggacttgagtgcagaagaggagagtggaattccacgtgtagcggtgaaatgcgtagatatgtggaggaacaccagtggcgaaggcggctctctggtctgtaactgacgctgaggcgcgaaagcgtggggagcaaacaggattagataccctggtagtccacgccgtaaacgatgagtgctaggtgttggggggttccaccctcagtgctgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacggtacaaagggcagcaacaccgcgaggtgaagcaaatcccataaagccgttctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtggggtaacctttatggagccagccgccgaaggtgggacaaatgattggggtgaagtcgtaacaaggtagccgtatcggaaggtgcggctggatcacctcctttcta

SEQ ID NO: 377 - DNA, 1555 bp, Bacillus sp. in Bacteria
  ref <308>: DATABASE ACCESSION NUMBER: NCBI ACCESSION: NZ_RKIY01000003.1
  ref <309>: DATABASE ENTRY DATE: 2019-04-01
  ref <313>: RELEVANT RESIDUES IN SEQ ID NO: (1)..(1555)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttct

SEQ ID NO: 378 - DNA, 1558 bp, Bacillus sp. m3-13
  ref <308>: DATABASE ACCESSION NUMBER: NCBI ACCESSION: NZ_ACPC01000001.1
  ref <309>: DATABASE ENTRY DATE: 2019-04-01
  ref <313>: RELEVANT RESIDUES IN SEQ ID NO: (1)..(1558)
ctttattggagagtttgatcctggctcaggacgaacgctggcggcgtgcctaatacatgcaagtcgagcggaccttttaaaagcttgcttttgaaaggtcagcggcggacgggtgagtaacacgtgggcaacctgcctgtaagactgggataacttcgggaaaccggagctaataccggataatataaggaacctcctggttctttattgaaagatggtttcggctatcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggtggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagcaaaaccgcgaggtcgagccaatcccataaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 379 - DNA, 1513 bp, Bacillus sp. mrc49
  ref <308>: DATABASE ACCESSION NUMBER: NCBI ACCESSION: NZ_PHNG01000808.1
  ref <309>: DATABASE ENTRY DATE: 2019-04-01
  ref <313>: RELEVANT RESIDUES IN SEQ ID NO: (1)..(1513)
aacgctggcggcaggcctaacacatgcaagtcgagcggtagcacagggagcttgctcctgggtgacgagcggcggacgggtgagtaatgtctgggaaactgcctgatggagggggataactactggaaacggtagctaataccgcataacgtctacggaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcagtcgtgttaatagcacggttgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 380 - DNA, 349 bp, Bacillus sp. nio-1130
  ref <308>: DATABASE ACCESSION NUMBER: NCBI ACCESSION: NZ_FMAS01000012.1
  ref <309>: DATABASE ENTRY DATE: 2019-04-01
  ref <313>: RELEVANT RESIDUES IN SEQ ID NO: (1)..(349)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcc

SEQ ID NO: 381 - DNA, 279 bp, Bacillus sp. ok061
  ref <308>: DATABASE ACCESSION NUMBER: NCBI ACCESSION: NZ_FNUW01000023.1
  ref <309>: DATABASE ENTRY DATE: 2019-04-01
  ref <313>: RELEVANT RESIDUES IN SEQ ID NO: (1)..(279)
tttattggagagtttgatcctggctcaggatgaacgctggcggcgtgcctaatacatgcaagttgagcgaatggattgagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctca

SEQ ID NO: 382 - DNA, 274 bp, Bacillus sp. ok634
  ref <308>: DATABASE ACCESSION NUMBER: NCBI ACCESSION: NZ_FOYB01000042.1
  ref <309>: DATABASE ENTRY DATE: 2019-04-01
  ref <313>: RELEVANT RESIDUES IN SEQ ID NO: (1)..(274)
tttattggagagtttgatcctggctcaggatgaacgctggcggcgtgcctaatacatgcaagtcgagcgaatggattaagagcttgctcttatgaagttagcggcggacgggtgagtaacacgtgggtaacctacccataagactgggataactccgggaaaccggggctaataccggataatattttgaactgcatagttcgaaattgaaaggcggcttcggctgtcacttatggatggacccgcgtcgcattagctagttggtgaggtaacg

SEQ ID NO: 383 - DNA, 281 bp, Bacillus sp. v-76
  ref <308>: DATABASE ACCESSION NUMBER: NCBI ACCESSION: NZ_FMBD01000086.1
  ref <309>: DATABASE ENTRY DATE: 2019-04-01
  ref <313>: RELEVANT RESIDUES IN SEQ ID NO: (1)..(281)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaagg

SEQ ID NO: 384 - DNA, 272 bp, Bacillus sp. yr331
  ref <308>: DATABASE ACCESSION NUMBER: NCBI ACCESSION: NZ_FNFG01000009.1
  ref <309>: DATABASE ENTRY DATE: 2019-04-01
  ref <313>: RELEVANT RESIDUES IN SEQ ID NO: (1)..(272)
tttattggagagtttgatcctggctcaggatgaacgctggcggcgtgcctaatacatgcaagtcgagcgaatggattaagagcttgctctcaagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaa

SEQ ID NO: 385 - DNA, 1005 bp, Bacillus sporothermodurans
  ref <308>: DATABASE ACCESSION NUMBER: NCBI ACCESSION: NZ_NAZD01000134.1
  ref <309>: DATABASE ENTRY DATE: 2019-04-01
  ref <313>: RELEVANT RESIDUES IN SEQ ID NO: (1)..(1005)
aacctgcctgtaagactgggataactccgggaaaccggggctaataccggataacttttttcttcgcatgaaggagaattgaaaggtggctctagctaccacttacagatggacccgcggcgcattagctagttggtgaggtaacggctcaccaaggcgacgatgcgtagccgacttgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctcttgacctccctagagatagggatttcccttcggggacaagagtgacaggtggtgcatggttgtcgtcagctcgtgtcgtgagatgttgggttaagtcccgcaacgagcgcaacccgtgacc

SEQ ID NO: 386 - DNA, 1548 bp, Bacillus stratosphericus
  ref <308>: DATABASE ACCESSION NUMBER: NCBI ACCESSION: NZ_PPGB01000026.1
  ref <309>: DATABASE ENTRY DATE: 2019-04-01
  ref <313>: RELEVANT RESIDUES IN SEQ ID NO: (1)..(1548)
tcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgataaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttct

SEQ ID NO: 387 - DNA, 1553 bp, Bacillus subterraneus
  ref <308>: DATABASE ACCESSION NUMBER: NCBI ACCESSION: NZ_RSFW01000004.1
  ref <309>: DATABASE ENTRY DATE: 2019-04-01
  ref <313>: RELEVANT RESIDUES IN SEQ ID NO: (1)..(1553)
ttcttggagagtttgatcctggctcaggacgaacgctggcggcgtgcctaatacatgcaagtcgagcggatcttcattagcttgcttttgaagatcagcggcggacgggtgagtaacacgtgggcaacctgcctgtaagactgggataacttcgggaaaccggagctaataccggataatcctttccctcacatgagggaaagctgaaagacggtttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggtcgcgaagccgcgaggtcgagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 388 - DNA, 1553 bp, Bacillus subtilis
  ref <308>: DATABASE ACCESSION NUMBER: NCBI ACCESSION: NZ_UAQD01000012.1
  ref <309>: DATABASE ENTRY DATE: 2019-04-01
  ref <313>: RELEVANT RESIDUES IN SEQ ID NO: (1)..(1553)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggttccttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 389 - DNA, 1530 bp, Bacillus subtilis
tttacggagagtttgatcctggctcaggatgaacgctggcggcgtgcttaacacatgcaagtcgaacggtgaagcaggagcttgctcttgtggatcagtggcgaacgggtgagtaacacgtgagcaacctgccccggactctgggataagcgctggaaacggcgtctaatactggatatgagacgtgaccgcatggtcgacgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtctgtcgcgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtcctttccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacgggccagaaatggtcaactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaaccccttgtgggagggagctgtcgaaggtgggatcggtaattaggactaagtcgtaacaaggtagccgtaccggaaggtgcggctggatcacctcctttcta

SEQ ID NO: 390 - DNA, 1483 bp, Bacillus subtilis
cagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 391 - DNA, 1507 bp, Bacillus swezeyi
  ref <308>: DATABASE ACCESSION NUMBER: NCBI ACCESSION: NZ_MRBK01000096.1
  ref <309>: DATABASE ENTRY DATE: 2019-04-01
  ref <313>: RELEVANT RESIDUES IN SEQ ID NO: (1)..(1507)
agagtttgatcctggctcaggacgaacgctggcggcgtgcctaatacatgcaagtcgagcgaaccgacgggagcttgctcccttaggttagcggcggacgggtgagtaacacgtgggtaacctgcctgtaagactgggataactccgggaaaccggggctaataccggatgcttgattgaaccgcatggttcaatcataaaaggcggcttcggctgccgtttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacacccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaagccgcgaggctcagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggta

SEQ ID NO: 392 - DNA, 1568 bp, Bacillus taeanensis
  ref <308>: DATABASE ACCESSION NUMBER: NCBI ACCESSION: NZ_QOCW01000052.1
  ref <309>: DATABASE ENTRY DATE: 2019-04-01
  ref <313>: RELEVANT RESIDUES IN SEQ ID NO: (1)..(1568)
atttgagagtttgatcctggctcaggacgaacgctggcggcgtgcctaatacatgcaagtcgagcgcgtgaaactaactgatcccttcggggtgacgttagtggatcgagcggcggacgggtgagtaacacgtgggcaacctgccctgcagatcgggataacttcgggaaaccggagctaataccgggtaacaaatggaatcgcatgattccattttgaaagttgggttttacctaacactgcaggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggggacttgagtacagaagaggagagtggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaggtgttagggggtttccgccccttagtgctgaagttaacacattaagcactccgcctggggagtacggccgcaaggctgaaactcaaaggaattgacgggggcccgcacaagcggtggagcatgtggtttaattcgaagcaacgcgaagaaccttaccaggtcttgacatcctctgccaaccctagagatagggcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaaccttttaggagccagccgcctaaggtggggcagatgattggggtgaagtcgtaacaaggtagccgtatcggaaggtgcggctggatcacctcctttcta

SEQ ID NO: 393 - DNA, 1554 bp, Bacillus tequilensis
  ref <308>: DATABASE ACCESSION NUMBER: NCBI ACCESSION: NZ_UAQB01000011.1
  ref <309>: DATABASE ENTRY DATE: 2019-04-01
  ref <313>: RELEVANT RESIDUES IN SEQ ID NO: (1)..(1554)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 394 - DNA, 1549 bp, Bacillus terrae
  ref <308>: DATABASE ACCESSION NUMBER: NCBI ACCESSION: NZ_QYTW02000044.1
  ref <309>: DATABASE ENTRY DATE: 2019-04-01
  ref <313>: RELEVANT RESIDUES IN SEQ ID NO: (1)..(1549)
ttattagagtttgatcctggctcaggacgaacgctggcggcgtgcctaatacatgcaagtcgagcggatgaaagggagcttgctccctggattcagcggcggacgggtgagtaacacgtgggcaacctgcctgtaagactgggataactccgggaaaccggggctaataccggataacttcttttctcgcatggggagaggttgaaagacggttatgctgtcacttacagatgggcccgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggccttcgggtcgtaaaactctgttatcagggaagaataagcattggttaactgccagtgccttgacggtacctgaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagagaacaggattagataccctggtattccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgcccgctctggagacagagtcttcccttcggggacagcggtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacagagggcagcaagaccgcgaggtggagcaaatcccttaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccatttggagccagccgccgaaggtgggacagatgattggggtgaagtcgtaacaaggtagccgtatcggaaggtgcggctggatcacctcctttcta

SEQ ID NO: 395 - DNA, 1554 bp, Bacillus thermoamylovorans
  ref <308>: DATABASE ACCESSION NUMBER: NCBI ACCESSION: NZ_CP023704.1
  ref <309>: DATABASE ENTRY DATE: 2019-04-01
  ref <313>: RELEVANT RESIDUES IN SEQ ID NO: (1)..(1554)
tttttggagagtttgatcctggctcaggacgaacgctggcggcgtgcctaatacatgcaagtcgagcgaaccaataagaagcttgctttttgttggttagcggcggacgggtgagtaacacgtgggtaacctgcctgtaagatcgggataactccgggaaaccggtgctaataccggatagattatctttccacctggagagataaggaaagatggcttttgccatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtatcggaggaaatgccggtaccttgacggtacctgacgagaaagccacggctaactacgtgccagcagccgcggtaatacgtaggtggcaagcgttgtccggatttattgggcgtaaagcgcgcgcaggcggtcctttaagtctgatgtgaaatcttgcggctcaaccgcaagcggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatctcctgaccgccctggagacagggtcttcccttcggggacaggatgacaggtggtgcatggttgtcgtcagctcgtgtcgtgagatgttgggttaagtcccgcaacgagcgcaacccttggttctagttgccagcattcagttgggcactctagagcgactgccggcgacaagtcggaggaaggtggggatgacgtcaaatcatcatgccccttatgacctgggctacacacgtgctacaatggatggtacaaagggcagcgaagcggcgacgcatgagcgaatcccagaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccgtaaggagccagccgccgaaggtgggacagatgattggggtgaagtcgtaacaaggtagccgtatcggaaggtgcggctggatcacctcctttcta

SEQ ID NO: 396 - DNA, 1558 bp, Bacillus thermocopriae
  ref <308>: DATABASE ACCESSION NUMBER: NCBI ACCESSION: NZ_CP026365.1
  ref <309>: DATABASE ENTRY DATE: 2019-04-01
  ref <313>: RELEVANT RESIDUES IN SEQ ID NO: (1)..(1558)
tctatggagagtttgatcctggctcaggacgaacgctggcggcgtgcctaatacatgcaagtcgagcggacgaatcgaaagcttgcttttgattcgttagcggcggacgggtgagtaacacgtgggtaacctgccctgtagacggggataacaccgagaaatcggtgctaataccggataacacgaaatgtcgcatgacgtttcgttgaaagacggcgtaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaacgcagtaactggcgttaccgtgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaaatgattggggtgaagtcgtaacaaggtagccgtatcggaaggtgcggctggatcacctcctttct

SEQ ID NO: 397 - DNA, 1555 bp, Bacillus timonensis
  ref <308>: DATABASE ACCESSION NUMBER: NCBI ACCESSION: NZ_CAET01000089.1
  ref <309>: DATABASE ENTRY DATE: 2019-04-01
  ref <313>: RELEVANT RESIDUES IN SEQ ID NO: (1)..(1555)
tcttattggagagtttgatcctggctcaggatgaacgctggcggcgtgcctaatacatgcaagtcgagcgaacctgagggagcttgctcccaaaggttagcggcggacgggtgagtaacacgtgggcaacctgcctgtaagactgggataacttcgggaaaccggagctaataccggataatataagagaccacatggtctcctattaaaagatggcttttcgctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtatcgttcgaatagggcggtaccttgacggtacctaaccagaaagccacggctaactacgtgccagcagccgcggtaatacgtaggtggcaagcgttatccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacactcctagagataggatttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaaaccgcgaggttaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 398 - DNA, 1556 bp, Bacillus toyonensis; identical to SEQ ID NO: 268
  ref <308>: DATABASE ACCESSION NUMBER: NCBI ACCESSION: NZ_MCAT01000009.1
  ref <309>: DATABASE ENTRY DATE: 2019-04-01
  ref <313>: RELEVANT RESIDUES IN SEQ ID NO: (1)..(1556)

SEQ ID NO: 399 - DNA, 1006 bp, Bacillus toyonensis
ttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgaca

SEQ ID NO: 400 - DNA, 1556 bp, Bacillus tropicus
  ref <308>: DATABASE ACCESSION NUMBER: NCBI ACCESSION: NZ_MACG01000025.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 401 - DNA, 1572 bp, Bacillus urumqiensis
  ref <308>: DATABASE ACCESSION NUMBER: NCBI ACCESSION: NZ_PVNS01000026.1
  ref <309>: DATABASE ENTRY DATE: 2019-04-01
  ref <313>: RELEVANT RESIDUES IN SEQ ID NO: (1)..(1572)
tttacggagagtttgatcctggctcaggacgaacgctggcggcgtgcctaatacatgcaagtcgagcgcaggaagccggcagatcccttcggggtgatgccggtggaatgagcggcggacgggtgagtaacacgtgggcaacctgccttccagactgggataaccccgggaaaccggggctaataccggataatcaaccggtccgcatggaccggctgtaaaagcgcggacttgttccgcgcactggaagatgggcccgcggcgcattagcttgttggtggggtagtggcccaccaaggcgacgatgcgtagccgacctgagagggtgatcggccacactgggactgagacacggcccagactcctacgggaggcagcagtagggaatcatccgcaatggacgaaagtctgacggtgcaacgccgcgtgaacgatgaaggttttcggatcgtaaagttctgttatgagggaagaacacgtgccggtcgaacaggccggcaccttgacggtacctcacgagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggggacttgagtgtaggagaggaaagtggaattccacgtgtagcggtgaaatgcgtagatatgtggaggaacaccagtggcgaaggcgactttctggcctacaactgacgctgaggcgcgaaagcgtggggagcaaacaggattagataccctggtagtccacgccgtaaacgttgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgacgcaacgcgaagaaccttaccaggtcttgacatcttttgcccgctctggagacagagttttccccttcgggggacaaaatgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacagagggacgcgagaccgcgaggtggagccaatcccaaaaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaacctttttggagccagccgccgaaggtgggacaaatgattggggtgaagtcgtaacaaggtatccgtaccggaaggtgcggatggatcacctcctttcta

SEQ ID NO: 402 - DNA, 1554 bp, Bacillus vallismortis
  ref <308>: DATABASE ACCESSION NUMBER: NCBI ACCESSION: NZ_CP026362.1
  ref <309>: DATABASE ENTRY DATE: 2019-04-01
  ref <313>: RELEVANT RESIDUES IN SEQ ID NO: (1)..(1554)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacctacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 403 - DNA, 1558 bp, Bacillus weihaiensis
  ref <308>: DATABASE ACCESSION NUMBER: NCBI ACCESSION: NZ_CP016020.1
  ref <309>: DATABASE ENTRY DATE: 2019-04-01
  ref <313>: RELEVANT RESIDUES IN SEQ ID NO: (1)..(1558)
ctttattggagagtttgatcctggctcaggacgaacgctggcggcgtgcctaatacatgcaagtcgagcgaattgatgggagcttgctccctgatattagcggcggacgggtgagtaacacgtgggtaacctgcctgtaagattgggataactccgggaaaccggagctaataccggataacatttcgaaccgcatggttcgaaattgaaagatggcttctagctatcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtactagagtaactgctagtaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatccttcgctacttctagagatagaaggttccccttttaggggacgaagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggatggtacaaagggctgcgagactgcgaagttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 404 - DNA, 1362 bp, Bacillus wiedmannii
  ref <308>: DATABASE ACCESSION NUMBER: NCBI ACCESSION: NZ_PYWP01000031.1
  ref <309>: DATABASE ENTRY DATE: 2019-04-01
  ref <313>: RELEVANT RESIDUES IN SEQ ID NO: (1)..(1362)
gttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttctatgga

SEQ ID NO: 405 - DNA, 1559 bp, Bacillus wudalianchiensis
  ref <308>: DATABASE ACCESSION NUMBER: NCBI ACCESSION: NZ_MAYT01000030.1
  ref <309>: DATABASE ENTRY DATE: 2019-04-01
  ref <313>: RELEVANT RESIDUES IN SEQ ID NO: (1)..(1559)
ctttttggagagtttgatcctggctcaggacgaacgctggcggcgtgcctaatacatgcaagtcgagcggacttgacggagcttgctctgttcaagttagcggcggacgggtgagtaacacgtgggtaacctgcctgtaagactgggataactccgggaaaccggggctaataccggatattcttttttctccgcatggagaaggatggaaaggcggcttcggctgctacttacagatggacccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgttagggaagaacaagtacgggagtaactgtccgtaccttgacggtacctaaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccggtctggagacagatctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcaaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgcctaaggtggggcagatgattggggtgaagtcgtaacaaggtagccgtatcggaaggtgcggctggatcacctcctttctaa

SEQ ID NO: 406 - DNA, 1553 bp, Bacillus zeae
  ref <308>: DATABASE ACCESSION NUMBER: NCBI ACCESSION: NZ_QWVT01000020.1
  ref <309>: DATABASE ENTRY DATE: 2019-04-01
  ref <313>: RELEVANT RESIDUES IN SEQ ID NO: (1)..(1553)
ttatcggagagtttgatcctggctcaggacgaacgctggcggcgtgcctaatacatgcaagtcgagcggacagatgggagcttgctccctgaagtcagcggcggacgggtgagtaacacgtgggcaacctgcctgtaagactgggataacttcgggaaaccggagctaataccggataatccttttcctcacatgggggaaagctgaaagacggtttcggctgtcacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtgccggagtaactgccggcaccttgacggtacctggccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatagaacaaagggcagcgaagccgcgaggtgaagccaatcccataaatctattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 407 - DNA, 1541 bp, Brevibacillus agri
  ref <308>: DATABASE ACCESSION NUMBER: NCBI ACCESSION: NZ_CP026363.1
  ref <309>: DATABASE ENTRY DATE: 2019-04-01
  ref <313>: RELEVANT RESIDUES IN SEQ ID NO: (1)..(1541)
tttattggagagtttgatcctggctcaggacgaacgctggcggcgtgcctaatacatgcaagtcgagcgagtcccttcgggggctagcggcggacgggtgagtaacacgtaggcaacctgcctctcagactgggataacatagggaaacttatgctaataccggataggtttttggatcgcatgattcgaaaagaaaagatggcttttggctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacacgtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 408 - DNA, 1524 bp, Brevibacillus borstelensis
  ref <308>: DATABASE ACCESSION NUMBER: NCBI ACCESSION: NZ_RHHO01000112.1
  ref <309>: DATABASE ENTRY DATE: 2019-04-01
  ref <313>: RELEVANT RESIDUES IN SEQ ID NO: (1)..(1524)
agagtttgatcctggctcaggacgaacgctggcggcgtgcctaatacatgcaagtcgagcgagtcccttcgggggctagcggcggacgggtgagtaacacgtaggcaacctgcccgtaagctcgggataacatggggaaactcatgctaataccggatagggtcttctctcgcatgagaggagacggaaaggtggcgcaagctaccacttacggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagagacgaacaagtaccgttcgaacagggcggtaccttgacggtacctgacgagaaagccacggctaactacgtgccagcagccgcggtaatacgtaggtggcaagcgttgtccggaattattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgtcctagagatagggcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggctggtacaacgggaagctagctcgcgagagtatgccaatctcttaaaaccagtctcagttcggattgcaggctgcaactcgcctgcatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacct

SEQ ID NO: 409 - DNA, 1541 bp, Brevibacillus brevis
  ref <308>: DATABASE ACCESSION NUMBER: NCBI ACCESSION: NZ_LR134338.1
  ref <309>: DATABASE ENTRY DATE: 2019-04-01
  ref <313>: RELEVANT RESIDUES IN SEQ ID NO: (1)..(1541)
tttattggagagtttgatcctggctcaggacgaacgctggcggcgtgcctaatacatgcaagtcgagcgagtctctttcagaggctagcggcggacgggtgagtaacacgtaggcaacctgcctctcagactgggataacatagggaaacttatgctaataccggatgggtttttggatcgcatgatccgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagtttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 410 - DNA, 1496 bp, Brevibacillus centrosporus
  ref <308>: DATABASE ACCESSION NUMBER: NCBI ACCESSION: NZ_RHHP01000044.1
  ref <309>: DATABASE ENTRY DATE: 2019-04-01
  ref <313>: RELEVANT RESIDUES IN SEQ ID NO: (1)..(1496)
gtgcctaatacatgcaagtcgagcgagtctcttcggaggctagcggcggacgggtgagtaacacgtaggcaacctgcccgtaagactgggataacatagggaaacttatgctaataccggatagagtctactctcgcatgagggaagacggaaaggtggcgcaagctatcacttacggatgggcctgcggcgcattagctagttggtggggtaatggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaacaagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatttctagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 411 - DNA, 1539 bp, Brevibacillus fluminis
  ref <308>: DATABASE ACCESSION NUMBER: NCBI ACCESSION: NZ_RHHQ01000042.1
  ref <309>: DATABASE ENTRY DATE: 2019-04-01
  ref <313>: RELEVANT RESIDUES IN SEQ ID NO: (1)..(1539)
ttaatggagagtttgatcctggctcaggacgaacgctggcggcgtgcctaatacatgcaagtcgagcgagtcccttcgggggctagcggcggacgggtgagtaacacgtaggcaacctgcctgtaagactgggataacatagggaaacttatgctaataccagatagggttttggatcgcatgatccgaaacggaaagatggcgcaagctatcacttacagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggctctcgggtcgtaaagttctgttgttagggacgaacaagtgccgttcgaatagggcggcaccttgacggtacctaacgagaaagccacggctaactacgtgccagcagccgcggtaatacgtaggtggcaagcgttgtccggaattattgggcgtaaagcgcgcgcaggcggttatgtaagtctgatgttaaagcccggggctcaacctcggtccgcattggaaactgtgtaacttgagtgcagaagaggaaagtggtattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggctggtacaacgggatgctagctcgcgagagtacgcaaatctcttaaaaccagtctcagttcggattgcaggctgcaactcgcctgcatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 412 - DNA, 1486 bp, Brevibacillus formosus
  ref <308>: DATABASE ACCESSION NUMBER: NCBI ACCESSION: NZ_PXZL01000058.1
  ref <309>: DATABASE ENTRY DATE: 2019-04-01
  ref <313>: RELEVANT RESIDUES IN SEQ ID NO: (1)..(1486)
cgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggatcgcatgatccgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaagg

SEQ ID NO: 413 - DNA, 1540 bp, Brevibacillus gelatini
  ref <308>: DATABASE ACCESSION NUMBER: NCBI ACCESSION: NZ_RHHS01000026.1
  ref <309>: DATABASE ENTRY DATE: 2019-04-01
  ref <313>: RELEVANT RESIDUES IN SEQ ID NO: (1)..(1540)
tttattggagagtttgatcctggctcaggacgaacgctggcggcgtgcctaatacatgcaagtcgagcgagggttttcgaaccctagcggcggacgggtgagtaacacgtaggcaacctgcctctcagaccgggataacatagggaaacttatgctaataccggataggtttttggatcgcatgatctgaaaaggaaagatggcgtttgctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaataagtaccgttcgaacagggcggtaccttgacggtacctgacgagaaagccacggctaactacgtgccagcagccgcggtaatacgtaggtggcaagcgttgtccggaattattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 414 - DNA, 1540 bp, Brevibacillus invocatus
  ref <308>: DATABASE ACCESSION NUMBER: NCBI ACCESSION: NZ_RHHR01000018.1
  ref <309>: DATABASE ENTRY DATE: 2019-04-01
  ref <313>: RELEVANT RESIDUES IN SEQ ID NO: (1)..(1540)
tttattggagagtttgatcctggctcaggacgaacgctggcggcgtgcctaatacatgcaagtcgagcgagggtcttcggaccctagcggcggacgggtgagtaacacgtaggcaacctgcccataagactgggataacatagggaaacttatgctaataccggatagagtcttctcccgcatgagagaagacggaaaggtggcgcaagctaccacttgtggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggccttcgggttgtaaagttctgttgtcagggacgaacaagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttaggggtttcaatacccttagtgccgcagctaacgcaataagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggatgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 415 - DNA, 1545 bp, Brevibacillus laterosporus
  ref <308>: DATABASE ACCESSION NUMBER: NCBI ACCESSION: NZ_CP032848.1
  ref <309>: DATABASE ENTRY DATE: 2019-04-01
  ref <313>: RELEVANT RESIDUES IN SEQ ID NO: (1)..(1545)
ttaatggagagtttgatcctggctcaggacgaacgctggcggcgtgcctaatacatgcaagtcgagcgagggttttcggaccctagcggcggacgggtgagtaacacgtaggcaacctgcctgtaagactgggataacatagggaaacttatgctaataccggatagagttttgcttcgcatgaagcgaaacggaaagatggcgcaagctatcacttgcagatgggcctgcggcgcattagctagttggtgaggtaaaggctcaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggctttcgggtcgtaaagttctgttgttagggaagaaacagtgccatttaaataaggtggcaccttgacggtacctaacgagaaagccacggctaactacgtgccagcagccgcggtaatacgtaggtggcaagcgttgtccggaattattgggcgtaaagcgcgcgcaggtggctatgtaagtctgatgttaaagcccggggctcaacctcggttcgcattggaaactgcgtagcttgagtgcaggagaggaaagtggtattccacgtgtagcggtgaaatgcgtagagatgtggaggaacaccagtggcgaaggcgactttctggcctgtaactgacactgaggcgcgaaagcgtggggagcaaacaggattagataccctggtagtccacgccgtaaacgatgagtgctaggtgttaggggtttcaatacccttagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccactgaccgctctagagatagagcttcccttcggggcagtggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacttcgcgagaagatgctaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagataactggggtgaagtcgtaacaaggtatccgtaccggaaggtgcggatggatcacctcctttctatggaga

SEQ ID NO: 416 - DNA, 1541 bp, Brevibacillus nitrificans
  ref <308>: DATABASE ACCESSION NUMBER: NCBI ACCESSION: NZ_RHHU01000019.1
  ref <309>: DATABASE ENTRY DATE: 2019-04-01
  ref <313>: RELEVANT RESIDUES IN SEQ ID NO: (1)..(1541)
tttattggagagtttgatcctggctcaggacgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggatcgcatgatccgaaaagaaaaggcggctttaagctgtcactgggagatgggcctgcggcgcattagctagttggtggggtaatggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaacaagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatttctagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 417 - DNA, 1540 bp, Brevibacillus panacihumi
  ref <308>: DATABASE ACCESSION NUMBER: NCBI ACCESSION: NZ_RHHT01000054.1
  ref <309>: DATABASE ENTRY DATE: 2019-04-01
  ref <313>: RELEVANT RESIDUES IN SEQ ID NO: (1)..(1540)
tttattggagagtttgatcctggctcaggacgaacgctggcggcgtgcctaatacatgcaagtcgagcgagggtcttcggaccctagcggcggacgggtgagtaacacgtaggcaacctgcccataagactgggataacatagggaaacttatgctaataccggatagagtcttctcccgcatgagaggagacggaaaggtggcgcaagctaccacttgtggatgggcctgcggcgcattagctagttggtggggtaacggcccaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacaagtaccgttcgaatagggcggtaccttgacggtacctgacgagaaagccacggctaactacgtgccagcagccgcggtaatacgtaggtggcaagcgttgtccggaattattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 418 - DNA, 1524 bp, Brevibacillus parabrevis
  ref <308>: DATABASE ACCESSION NUMBER: NCBI ACCESSION: NZ_RHHV01000040.1
  ref <309>: DATABASE ENTRY DATE: 2019-04-01
  ref <313>: RELEVANT RESIDUES IN SEQ ID NO: (1)..(1524)
agagtttgatcctggctcaggacgaacgctggcggcgtgcctaatacatgcaagtcgagcgagggttttcggaccctagcggcggacgggtgagtaacacgtaggcaacctgcctctcagaccgggataacatagggaaacttatgctaataccggataggtttttggattgcatgatccgaaaagaaaagatggcttcggctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacacgtgccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctctgaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacct

SEQ ID NO: 419 - DNA, 1565 bp, Brevibacillus reuszeri
  ref <308>: DATABASE ACCESSION NUMBER: NCBI ACCESSION: NZ_BEXF01000069.1
  ref <309>: DATABASE ENTRY DATE: 2019-04-01
  ref <313>: RELEVANT RESIDUES IN SEQ ID NO: (1)..(1565)
tttttggagagtttgatcctggctcaggacgaacgctggcggcgtgcctaatacatgcaagtcgagcggacttgatggagtgcttgcactcctgatagttagcggcggacgggtgagtaacacgtaggcaacctgccctcaagactgggataactaccggaaacggtagctaataccggataatttattacatagcattatgtaataatgaaagacggagcaatctgtcacttggggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtctcatagagtaactgctatgagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacctggggctcaacttcaggtcgcactggaaactgggggacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatctgctagagatagcagcggccttcgggacagaggagacaggtggtgcatggttgtcgtcagctcgtgtcgtgagatgttgggttaagtcccgcaacgagcgcaacccttgattttagttgccagcaggtaaggctgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 420 - DNA, 1542 bp, Brevibacillus sp. CF112
  ref <308>: DATABASE ACCESSION NUMBER: NCBI ACCESSION: NZ_AKKB01000112.1
  ref <309>: DATABASE ENTRY DATE: 2019-04-01
  ref <313>: RELEVANT RESIDUES IN SEQ ID NO: (1)..(1542)
ctttattggagagtttgatcctggctcaggacgaacgctggcggcgtgcctaatacatgcaagtcgagcgagtcccttcgggggctagcggcggacgggtgagtaacacgtaggcaacctgcctctcagactgggataacatagggaaacttatgctaataccggataggtttttggatcgcatgatctgaaaagaaaagatggcttttcgctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacacgtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 421 - DNA, 1540 bp, Brevibacillus sp. Leaf182
  ref <308>: DATABASE ACCESSION NUMBER: NCBI ACCESSION: NZ_LMPN02000002.1
  ref <309>: DATABASE ENTRY DATE: 2019-04-01
  ref <313>: RELEVANT RESIDUES IN SEQ ID NO: (1)..(1540)
tttattggagagtttgatcctggctcaggacgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggatcgcatgatccgaaaagaaaagatggcttcggctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 422 - DNA, 1540 bp, Brevibacillus sp. NRRL B-41110
  ref <308>: DATABASE ACCESSION NUMBER: NCBI ACCESSION: NZ_PXZO01000062.1
  ref <309>: DATABASE ENTRY DATE: 2019-04-01
  ref <313>: RELEVANT RESIDUES IN SEQ ID NO: (1)..(1540)
tttattggagagtttgatcctggctcaggacgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggatcgcatgatccgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgaggggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 423 - DNA, 1540 bp, Brevibacillus sp. NRRL NRS-1210
  ref <308>: DATABASE ACCESSION NUMBER: NCBI ACCESSION: NZ_PXZM01000027.1
  ref <309>: DATABASE ENTRY DATE: 2019-04-01
  ref <313>: RELEVANT RESIDUES IN SEQ ID NO: (1)..(1540)
tttattggagagtttgatcctggctcaggacgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggatcgcatgatccgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 424 - DNA, 1486 bp, Brevibacillus sp. NRRL NRS-603
  ref <308>: DATABASE ACCESSION NUMBER: NCBI ACCESSION: NZ_PXZN01000188.1
  ref <309>: DATABASE ENTRY DATE: 2019-04-01
  ref <313>: RELEVANT RESIDUES IN SEQ ID NO: (1)..(1486)
cgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggatcgcatgattcgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaagg

SEQ ID NO: 425 - DNA, 1541 bp, Brevibacillus sp. OK042
  ref <308>: DATABASE ACCESSION NUMBER: NCBI ACCESSION: NZ_FORT01000035.1
  ref <309>: DATABASE ENTRY DATE: 2019-04-01
  ref <313>: RELEVANT RESIDUES IN SEQ ID NO: (1)..(1541)
ctttattggagagtttgatcctggctcaggacgaacgctggcggcgtgcctaatacatgcaagtcgagcgagtctcttcggaggctagcggcggacgggtgagtaacacgtaggcaacctgcccgtaagactgggataacatagggaaacttatgctaataccggatagagtctactctcgcatgagggaagacggaaaggtggcgcaagctatcacttacggatgggcctgcggcgcattagctagttggtggggtaatggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaacaagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatttctagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 426 - DNA, 1555 bp, Brevibacillus sp. SCSIO 07484
  ref <308>: DATABASE ACCESSION NUMBER: NCBI ACCESSION: NZ_CP034541.1
  ref <309>: DATABASE ENTRY DATE: 2019-04-01
  ref <313>: RELEVANT RESIDUES IN SEQ ID NO: (1)..(1555)
ttttggagagtttgatcctggctcaggacgaacgctggcggcgtgcctaatacatgcaagtcgagcggggtttggcgggagcttgcttctgcgaagcccagcggcggacgggtgagtaacacgtaggcaacctgcccgcaagaccgggataacatagggaaacttatgctaataccggatagggtcgcgccccgcatggggcgggacggaaaggtggcgcaagctaccacttgcggatgggcctgcggcgcattagctagttggtgaggtaacggctcaccaaggcgacgatgcgtagccgacctgagagggtgaccggccacactgggactgagacacggcccagactcctacgggaggcagcagtagggaattttccacaatgggcgaaagcctgatggagcaacgccgcgtgaacgaagaaggccttcgggttgtaaagttctgttgtcagggacgaaaccgtaccgttcgaagagggcggtaccttgacggtacctgacgaggaagccacggctaactacgtgccagcagccgcggtaatacgtaggtggcaagcgttgtccggaattattgggcgtaaagcgcgcgcaggcggccgggtaagtctggtgtgaaagcccggggctcaaccccggtgtgcattggaaactgcctggcttgagtgcaggagagggaagcggtattccacgtgtagcggtgaaatgcgtagagatgtggaggaacaccagtggcgaaggcggctttctggcctgtaactgacgctgaggcgcgaaagcgtggggagcaaacaggattagataccctggtagtccacgccgtaaacgatgagtgctaggtgttgggggttttgacaccctcagtgccgcagctaacgcaataagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctccagagatggggcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggctggtacaacgggacgcaagcccgcgagggtgagccaatctctgaaaaccagtctcagttcggattgcaggctgcaactcgcctgcatgaagtcggaatcgctagtaatcgcggatcagcatgccgcggtgaatacgttcccgggccttgtacacaccgcccgtcacaccacgagagtttgcaacacccgaagtcggtgaggtaacccgcaagggagccagccgccgaaggtggggcagatgattggggtgaagtcgtaacaaggtatccgtaccggaaggtgcggatggatcacctcctttct

SEQ ID NO: 427 - DNA, 1172 bp, Brevibacillus sp. VP
  ref <308>: DATABASE ACCESSION NUMBER: NCBI ACCESSION: NZ_QUQX01000049.1
  ref <309>: DATABASE ENTRY DATE: 2019-04-01
  ref <313>: RELEVANT RESIDUES IN SEQ ID NO: (1)..(1172)
acgatgcgtagccgacctgagagggtgaccggccacactgggactgagacacggcccagactcctacgggaggcagcagtagggaattttccacaatggacgaaagtctgatggagcaacgccgcgtgaacgatgaaggctttcgggtcgtaaagttctgttgttagggaagaaacagtgctatttaaataaggtagcaccttgacggtacctaacgagaaagccacggctaactacgtgccagcagccgcggtaatacgtaggtggcaagcgttgtccggaattattgggcgtaaagcgcgcgcaggtggctatgtaagtctgatgttaaagcccgaggctcaacctcggttcgcattggaaactgtgtagcttgagtgcaggagaggaaagtggtattccacgtgtagcggtgaaatgcgtagagatgtggaggaacaccagtggcgaaggcgactttctggcctgtaactgacactgaggcgcgaaagcgtggggagcaaacaggattagataccctggtagtccacgccgtaaacgatgagtgctaggtgttaggggtttcaatacccttagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccactgaccgctctagagatagagcttcccttcggggcagtggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacttcgcgagaagatgctaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccg

SEQ ID NO: 428 - DNA, 1234 bp, Caloramator fervidus
  ref <308>: DATABASE ACCESSION NUMBER: NCBI ACCESSION: NZ_FNUK01000046.1
  ref <309>: DATABASE ENTRY DATE: 2019-04-01
  ref <313>: RELEVANT RESIDUES IN SEQ ID NO: (1)..(1234)
cggcctgagagggtggtcggccacactgggactgagacacggcccagactcctacgggaggcagcagtggggaatattgcgcaatgggggaaaccctgacgcagcgacgccgcgtgagcgaagaaggccttcgggtcgtaaagctctgtcttccctgacgaaggaagtgacggtaagggaggaggaagccacggctaactacgtgccagcagccgcggtaatacgtaggtggcgagcgttgtccggaattactgggcgtaaagggtgcgtaggcggccccttaagtgaggtgtgaaatccctgggctcaacccaggaactgcacttcaaactggggggctagagtgcaggagaggaaagcggaattcccggtgtagcggtgaaatgcgtagagatcgggaggaacaccagtggcgaaggcggctttctggactgcaactgacgctgaggcacgaaagcgtggggagcaaacaggattagataccctggtagtccacgctgtaaacgatgggtgctaggtgtggggggcgtagccttccgtgccgtagttaacacattaagcaccccgcctggggagtacggtcgcaagactaaaactcaaaggaattgacgggggcccgcacaagcagcggagcatgtggtttaattcgaagcaacgcgaagaaccttaccagggcttgacatccaccgaaccctgtggaaacacgggggtgccccttatggggagcggtgagacaggtggtgcatggttgtcgtcagctcgtgtcgtgagatgttgggttaagtcccgcaacgagcgcaacccctatcgttagttgccagcacttcgggtgggcactctaacgagactgccagggtaacctggaggaaggtggggatgacgtcaaatcatcatgccccttatgccctgggctacacacgtgctacaatggccactacagagagaagcgaacccgcgagggggagcaaatcttgaaaggtggtcccagttcggattgcaggctgcaactcgcctgcatgaagccggagttgctagtaatcgcggatcagcatgccgcggtgaatacgttcccgggccttgtacacaccgcccgtcacaccatgagagccggcaacacccgaagccagtgggctaacccgaaagggaggcagctgtcgaaggtggggctggtgattggggtgaagtcgtaacaaggtagccgtaggagaacctgcggctggatcacctcctttct

SEQ ID NO: 429 - DNA, 1442 bp, Caminicella sporogenes
  ref <308>: DATABASE ACCESSION NUMBER: NCBI ACCESSION: NZ_FRAJ01000002.1
  ref <309>: DATABASE ENTRY DATE: 2019-04-01
  ref <313>: RELEVANT RESIDUES IN SEQ ID NO: (1)..(1442)
aagattaaagcttagcggcggacgggtgagtaacgcgtgggcaacctgccctgtgcagggggataacacatcgaaaggtgtgctaataccccataagactacgatgtcgcatggcatagtagtaaaagctgaggcggcacaggatgggcccgcgtctgattagctagttggtagggtaacggcctaccaaggcaacgatcagtagccgacctgagagggtgaacggccacactggaactgagacacggtccagactcctacgggaggcagcagtggggaatattgcacaatgggggaaaccctgatgcagcaacgccgcgtgagcgaagaaggccttcgggtcgtaaagctctgtcctaagggaagaaagatgacggtaccttaggaggaagccccggctaactacgtgccagcagccgcggtaaaacgtagggggcgagcgttatccggaatgactgggcgtaaagggtgtgtaggcggccggtaaagtctggggtgaaaggctacggcttaaccgtagtaagccttggaaacttatcggcttgagtgcaggagaggagagcggaattcctagtgtagcggtgaaatgcgtagatattaggaggaacaccagtggcgaaggcggctctctggactgcaactgacgctgaggcacgaaagcgtggggagcgaacaggattagataccctggtagtccacgccgtaaacgatgagtgctaggtgttggaggttcataccttcagtgccgcagttaacgcattaagcactccgcctggggagtacggtcgcaagactgaaactcaaaggaattgacggggacccgcacaagcagcggagcatgtggtttaattcgaagcaacgcgaagaaccttaccaggacttgacatccctgtgacagcttcttaatcgaagccttcccttcggggacacaggagacaggtggtgcatggttgtcgtcagctcgtgtcgtgagatgttgggttaagtcccgcaacgagcgcaacccttgtctttagttgccagcacttagggtgggcactctaaagagactgccggtgataaaccggaggaaggtggggatgacgtcaaatcatcatgccccttatgttctgggctacacacgtgctacaatggctggtacaaagggaagcgaaggagtaatccggagcgaatcccaaaaagccagtcccagttcggattgtgggctgcaactcgcccacatgaagccggagttgctagtaatcgcgaatcagaatgtcgcggtgaatacgttcccgggtcttgtacacaccgcccgtcacaccatgggagcccatggcacccgaagtcagtgagtcaaccgtaaaggagacagctgccgaaggtgaaatgggtgactggggtgaagtcgtaacaaggtagccgtatcggaaggtgcggctggatcacctcctttctaagga

SEQ ID NO: 430 - DNA, 1519 bp, Clostridium acetireducens
  ref <308>: DATABASE ACCESSION NUMBER: NCBI ACCESSION: NZ_LZFO01000074.1
  ref <309>: DATABASE ENTRY DATE: 2019-04-01
  ref <313>: RELEVANT RESIDUES IN SEQ ID NO: (1)..(1519)
tttaaattaagagtttgatcctggctcaggacgaacgctggcggcgtgcctaacacatgcaagtcgagcgatgaaacttccttcgggaagtgaattagcggcggacgggtgagtatcacgtgggcaacctgcctcaaagaggggaatagccttccgaaaggaagattaataccgcataatattagaaattcgcatgaatttctaatcaaaggagtaatccgctttgagatgggcccgcggcgcattagctagttggtggggtaatagcctaccaaggcaacgatgcgtagccgacctgagagggtgaacggccacattggaactgagatacggtccagactcctacgggaggcagcagtggggaatattgcgcaatgggggaaaccctgacgcagcaacgccgcgtgagcgatgaaggtcttcggatcgtaaagctctgtcttttgggacgataatgacggtaccaaaagaggaagccacggctaactacgtgccagcagccgcggtaatacgtaggtggcgagcgttgtccggaattactgggcgtaaagggtgcgtaggcggatatttaagtcagatgtgaaatacccaggcttaacttgggagttgcatttgaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgctgtaaacgatgaatactaggtgtaggaggtatcatcccttctgtgccgcagttaacacaataagtattccgcctggggagtacggtcgcaagattaaaactcaaaggaattgacgggggcccgcacaagcagcggagcatgtggtttaattcgaagcaacgcgaagaaccttacctagacttgacatcccctgaattactcgtaatagaggaaatcccttcggggacagggagacaggtggtgcatggttgtcgtcagctcgtgtcgtgagatgttgggttaagtcccgcaacgagcgcaacccttgttattagttgctaccattaagttgagcactctaataagactgcccgggtcaaccgggaggaaggtggggatgacgtcaaatcatcatgccccttatgtctagggctacacacgtgctacaatggtaagtacagagagatgcaaattcgcaaggaagagcaaatctcaaaaacttatcccagttcggattgcaggctgaaactcgcctgcatgaagtcggagttgctagtaatcgcaaatcagaatgttgcggtgaatacgttcccgggccttgtacacaccgcccgtcacaccatgagagctggtaacacccgaagtccgtgaggtaaccgtaaggaaccagcggccgaaggtgggattagtgattggggtgaagtcgtaacaaggtagccgtaggagaacctgcggctggatcacctcctttcta

SEQ ID NO: 431 - DNA, 1511 bp, Clostridium acetobutylicum
  ref <308>: DATABASE ACCESSION NUMBER: NCBI ACCESSION: NZ_CP030018.1
  ref <309>: DATABASE ENTRY DATE: 2019-04-01
  ref <313>: RELEVANT RESIDUES IN SEQ ID NO: (1)..(1511)
tttaaattgagagtttgatcctggctcaggacgaacgctggcggcgtgcttaacacatgcaagtcgagcggggaacttcggttcccagcggcggacgggtgagtaacacgtgggtaacctacctcatagtggggaatagcctttcgaaaggaagattaataccgcataatactcgagaatcgcatgattcttgagccaaaggatttattcgctatgagatggacccgcggcgcattagcttgttggtgaggtaacggctcaccaaggcttcgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggatcgtaaaactctgtcttatgggacgataatgacggtaccataggaggaagccacggctaactacgtgccagcagccgcggtaatacgtaggtggcaagcgttgtccggatttactgggcgtaaaggatgtgtaggcggatatttaagtgagatgtgaaatccccgggcttaacttgggggctgcatttcaaactggatgtctggagtgcaggagaggaaggcagaattcctagtgtagcggtgaaatgcgtagagattaggaagaataccagtggcgaaggcggccttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattagtccgtaatggatgaagtcccttcggggacaggatgacaggtggtgcatggttgtcgtcagctcgtgtcgtgagatgttgggttaagtcccgcaacgagcgcaacccttatcattagttgctaacatttagttgagcactctagtgagactgcccgggttaaccgggaggaaggtggggatgacgtcaaatcatcatgccccttatgtctagggctacacacgtgctacaatggtggggacaaaaagatgcaataccgcaaggtggagcaaaactcaaaaccctatcccagttcggattgtaggctgaaactcgcctacatgaagccggagttgctagtaatcgcgaatcagaatgtcgcggtgaatacgttcccgggtcttgtacacaccgcccgtcacaccatgagagtcggcaacacccgaagcccgtgaggtaaccttttggaaccagcggtcgaaggtggggttgataattggggtgaagtcgtaacaaggtagccgtaggagaacctgcggctggatcacctcttttcta

SEQ ID NO: 432 - DNA, 1521 bp, Clostridium algidicarnis
  ref <308>: DATABASE ACCESSION NUMBER: NCBI ACCESSION: NZ_PTIS01000038.1
  ref <309>: DATABASE ENTRY DATE: 2019-04-01
  ref <313>: RELEVANT RESIDUES IN SEQ ID NO: (1)..(1521)
tttaaattgagagtttgatcctggctcaggacgaacgctggcggcgtgcttaacacatgcaagtcgagcgaagttattccttcggggataacttagcggcggacgggtgagtaacacgtgggtaacctgcctcatagagggggatagccttccgaaaggaagattaataccccataacatagcattatcgcatgataaagttattaaaggagtaatccgctatgagatggacccgcggcgcattagctagttggtgaggtaacggctcaccaaggccacgatgcgtagccgacctgagagggtgatcggccacattgggactgagacacggcccagactcctacgggaggcagcagtggggaatattgcacaatgggcgaaagcctgatgcagcaacgccgcgtgagtgatgaaggccttcgggtcgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatacttaagtgggatgtgaaatacccgggctcaacccgggtgctgcattccaaactgggtatctagagtgtgggagaggaaagtggaattcctagtgtagcggtgaaatgcgtagagattaggaagaacaccagtggcgaaggcgactttctggaccataactgacgctgaggctcgaaagcgtggggagcaaacaggattagataccctggtagtccacgccgtaaacgatggatactaggtgtgggggataccaatcctccgtgccgtcgttaacacactaagtatcccgcctggggagtacgatcgcaagattaaaactcaaaggaattgacgggggcccgcacaagcagcggagcatgtggtttaattcgaagcaacgcgaagaaccttacctagacttgacatctcctgaattacctgtaattagggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcctgggttaaccaggaggaaggtggggatgacgtcaaatcatcatgccccttatgtctagggctacacacgtgctacaatggcgagtacaacgagacgcaataccgcgaggtggagcaaaactcaaaaaactcgtcccagttcggattgtaggctgaaactcgcctacatgaagccggagttgctagtaatcgcgaatcagaatgtcgcggtgaatacgttcccgggccttgtacacaccgcccgtcacaccatgagagttggcaatacccgaagtccgtgcgctaacgcgtaagcgaggcagcggccgaaggtagggtcagcgattggggtgaagtcgtaacaaggtagccgtaggagaacctgcggctggatcacctcctttctatgga

SEQ ID NO: 433 - DNA, 1516 bp, Clostridium amazonitimonense
  ref <308>: DATABASE ACCESSION NUMBER: NCBI ACCESSION: NZ_CCFK01000005.1
  ref <309>: DATABASE ENTRY DATE: 2019-04-01
  ref <313>: RELEVANT RESIDUES IN SEQ ID NO: (1)..(1516)
tttaaattgagagtttgatcctggctcaggacgaacgctggcggcgtgcttaacacatgcaagtcgagcgagggagttccttcgggaacaacctagcggcggacgggtgagtaacacgtgggcaacctgcctcgtagagggggatagccctccgaaaggaggattaataccccataatattgatttatcgcatgatagattaattaaaggagtaatccgctacgagatgggcccgcggcgcattagctagttggtgaggtaacggctcaccaaggccacgatgcgtagccgacctgagagggtgatcggccacattgggactgagacacggcccagactcctacgggaggcagcagtggggaatattgcacaatgggcgaaagcctgatgcagcaacgccgcgtgagtgaagaaggccttcgggttgtaaagctctgtcttcagggacgataatgacggtacctgaggaggaagccacggctaactacgtgccagcagccgcggtaatacgtaggtggcaagcgttgtccggatttactgggcgtaaagggagcgtaggcggatacttaagtgggatgtgaaatacccgggctcaacccgggtgctgcattccaaactgggtatctagagtgcaggagaggaaagtggaattcctagtgtagcggtgaaatgcgtagagattaggaagaacaccagtggcgaaggcgactttctggactgtaactgacgctgaggctcgaaagcgtggggagcaaacaggattagataccctggtagtccacgccgtaaacgatggatactaggtgtgggaggtaccaaccttccgtgccgccgttaacacaataagtatcccgcctggggagtacggtcgcaagattaaaactcaaaggaattgacgggggcccgcacaagcagcggagcatgtggtttaattcgaagcaacgcgaagaaccttacctagacttgacatctcctgaattacctttaataagggaagcccttcggggcaggaagacaggtggtgcatggttgtcgtcagctcgtgtcgtgagatgttgggttaagtcccgcaacgagcgcaacccttattgttagttgctaccattaagttgagcactctagcgagactgcctgggttaaccaggaggaaggtggggatgacgtcaaatcatcatgccccttatgtctagggctacacacgtgctacaatggcgagtacaacgagaagcaagatcgcaaggtggagcaaaactcaaaaactcgtcccagttcggattgtaggctgaaactcgcctacatgaagccggagttgctagtaatcgcgaatcagaatgtcgcggtgaatacgttcccgggccttgtacacaccgcccgtcacaccatgagagttggcaatacccgaagtccgtgagctaacgcgtaagcggggcagcggccgaaggtagggtcagcgattggggtgaagtcgtaacaaggtagccgtaggagaacctgcggctggatcacctcctttcta

SEQ ID NO: 434 - DNA, 1515 bp, Clostridium autoethanogenum
  ref <308>: DATABASE ACCESSION NUMBER: NCBI ACCESSION: NZ_RFAQ01000128.1
  ref <309>: DATABASE ENTRY DATE: 2019-04-01
  ref <313>: RELEVANT RESIDUES IN SEQ ID NO: (1)..(1515)
tttaaattaagagtttgatcctggctcaggacgaacgctggcggcgtgcttaacacatgcaagtcgagcgatgaagctccttcgggagtggattagcggcggacgggtgagtaacacgtgggtaacctacctcaaagagggggatagcctcccgaaagggagattaataccgcataataatcagttttcacatggagactgatttaaaggagtaatccgctttgagatggacccgcggcgcattagctagttggtagggtaacggcctaccaaggcgacgatgcgtagccgacctgagagggtgatcggccacattggaactgagagacggtccagactcctacgggaggcagcagtggggaatattgcacaatgggcgaaagcctgatgcagcaacgccgcgtgagtgaagaaggttttcggattgtaaagctctgtctttggggacgataatgacggtacccaaggaggaagccacggctaactacgtgccagcagccgcggtaatacgtaggtggcgagcgttgtccggaattactgggcgtaaagagtgcgtaggcggatatttaagtgagatgtgaaatacccgggcttaacccgggcactgcatttcaaactggatatctagagtgcgggagaggagaatggaattcctagtgtagcggtgaaatgcgtagagattaggaagaacaccagtggcgaaggcgattctctggaccgtaactgacgctgaggcacgaaagcgtgggtagcaaacaggattagataccctggtagtccacgccgtaaacgatgagtactaggtgtaggaggtatcgaccccttctgtgccgcagtaaacacaataagtactccgcctgggaagtacgatcgcaagattaaaactcaaaggaattgacgggggcccgcacaagcagcggagcatgtggtttaattcgaagcaacgcgaagaaccttacctggacttgacataccctgaatatcttagagataagagaagcccttcggggcagggatacaggtggtgcatggttgtcgtcagctcgtgtcgtgagatgttaggttaagtcctgcaacgagcgcaacccctgttgttagttgctaacatttagttgagcactctagcaagactgccgcggttaacgcggaggaaggtggggatgacgtcaaatcatcatgccccttatgtccagggcaacacacgtgctacaatgggcagtacagagagaagcaagaccgcaaggtggagcaaacctcaaaaactgcccccagttcggattgcaggctgaaactcgcctacatgaagttggagttgctagtaatcgcgaatcagaatgtcgcggtgaatacgttcccgggccttgtacacaccgcccgtcacaccatgagagctggcaacacccgaagtccgtagtctaacttaggaggacgcggccgaaggtggggttagtaattggggtgaagtcgtaacaaggtagccgtaggagaacctgcggctggatcacctcctttcta

SEQ ID NO: 435 - DNA, 1515 bp, Clostridium beijerinckii
  ref <308>: DATABASE ACCESSION NUMBER: NCBI ACCESSION: NZ_UARH01000014.1
  ref <309>: DATABASE ENTRY DATE: 2019-04-01
  ref <313>: RELEVANT RESIDUES IN SEQ ID NO: (1)..(1515)
tttattgagagtttgatcctggctcaggacgaacgctggcggcgtgcttaacacatgcaagtcgagcgatgaagctccttcgggagcggattagcggcggacgggtgagtaacacgtgggtaacctgcctcatagagtggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgcaagcgaggcagcgacctaaggtagggtcagcgattggggtgaagtcgtaacaaggtagccgtaggagaacctgcggctggatcacctcctttcta

SEQ ID NO: 436 - DNA, 1517 bp, Clostridium botulinum
  ref <308>: DATABASE ACCESSION NUMBER: NCBI ACCESSION: NZ_UFWX01000001.1
  ref <309>: DATABASE ENTRY DATE: 2019-04-01
  ref <313>: RELEVANT RESIDUES IN SEQ ID NO: (1)..(1517)
ttaaaattgagagtttgatcctggctcaggacgaacgctggcggcgtgcttaacacatgcaagtcgagcgatgaagcttccttcgggaagtggattagcggcggacgggtgagtaacacgtgggtaacctgcctcaaagtgggggatagccttccgaaaggaagattaataccgcataacataagagaatcgcatgattttcttatcaaagatttattgctttgagatggacccgcggcgcattagctagttggtaaggtaacggcttaccaaggcaacgatgcgtagccgacctgagagggtgatcggccacattggaactgagacacggtccagactcctacgggaggcagcagtggggaatattgcgcaatgggggaaaccctgacgcagcaacgccgcgtgggtgatgaaggtcttcggattgtaaagccctgttttctgggacgataatgacggtaccagaggaggaagccacggctaactacgtgccagcagccgcggtaatacgtaggtggcgagcgttgtccggatttactgggcgtaaagggtgcgtaggcggatgtttaagtgggatgtgaaatccccgggcttaacctgggggctgcattccaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatggatactaggtgtagggggtatcaactccccctgtgccgcagttaacacaataagtatcccgcctggggagtacggtcgcaagattaaaactcaaaggaattgacgggggcccgcacaagcagcggagcatgtggtttaattcgaagcaacgcgaagaaccttacctggacttgacatcccttgcatagcctagagataggtgaagcccttcggggcaaggagacaggtggtgcatggttgtcgtcagctcgtgtcgtgagatgttaggttaagtcctgcaacgagcgcaacccttgttattagttgctaccattaagttgagcactctaatgagactgcctgggtaaccaggaggaaggtggggatgacgtcaaatcatcatgccccttatgtccagggctacacacgtgctacaatggtaggtacaataagacgcaagaccgtgaggtggagcaaaacttataaaacctatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggctggatcacctcctttcta

SEQ ID NO: 437 - DNA, 1350 bp, Clostridium butyricum
  misc_feature (1346)..(1346): n is a, c, g, or t
  ref <308>: DATABASE ACCESSION NUMBER: NCBI ACCESSION: NZ_RSEV01000001.1
  ref <309>: DATABASE ENTRY DATE: 2019-04-01
  ref <313>: RELEVANT RESIDUES IN SEQ ID NO: (1)..(1350)
ctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacncggc

SEQ ID NO: 438 - DNA, 1523 bp, Clostridium cadaveris
  ref <308>: DATABASE ACCESSION NUMBER: NCBI ACCESSION: NZ_OBJM01000014.1
  ref <309>: DATABASE ENTRY DATE: 2019-04-01
  ref <313>: RELEVANT RESIDUES IN SEQ ID NO: (1)..(1523)
ttttaaattgagagtttgatcctggctcaggatgaacgctggcggcgtgcttaacacatgcaagtcgagcgagggagcaccttcgggtgtgaactagcggcggacgggtgagtaacacgtgggcaacctgccttacagagggggatagccttccgaaaggaagattaataccgcatattatgatttttctgcatgggaaagtcatgaaaggagcaatccgctgtaagatgggcccgcggcgcattagctagttggtgaggtaagggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtcttcagggacgataatgacggtacctgaggaggaagccacggctaactacgtgccagcagccgcggtaatacgtaggtggcgagcgttatccggatttactgggcgtaaaggatgcgtaggtggaattttaagtgggatgtgaaatacccgggctcaacctgggaactgcattccaaactggaattctagagtgcaggagaggaaagcggaattcctagtgtagcggtgaaatgcgtagagattaggaagaacaccagtggcgaaggcggctttctggactgtaactgacactgaggcatgaaagcgtggggagcaaacaggattagataccctggtagtccacgccgtaaacgatgggtactaggtgtaggggtttcgatacctctgtgccgccgtaaacacaataagtaccccgcctggggagtacggtcgcaagattaaaactcaaaggaattgacgggggcccgcacaagtagcggagcatgtggtttaattcgaagcaacgcgaagaaccttacctagacttgacatgtcctgaattacctgtaataagggaagctctttcgggagcaggaacacaggtggtgcatggttgtcgtcagctcgtgtcgtgagatgttgggttaagtcccgcaacgagcgcaacccctatagttagttgctaacagtaagatgagcactctagctagactgccgtggttaacgcggaggaaggtggggatgacgtcaaatcatcatgccccttatgtctagggctacacacgtgctacaatggcgagaacaaagagaagcaagaccgcgaggtggagcaaaactcataaaactcgtcccagttcggattgcaggctgcaactcgcctgcatgaagccggagttactagtaatcgcgaatcagaatgtcgcggtgaatacgttcccgggccttgtacacaccgcccgtcacaccatgagagttggcaatacccaaagtccgtgaggtaaccgaaaggagccagcggcctaaggtagggtcagcgattggggtgaagtcgtaacaaggtagccgtaggagaacctgcggctggatcacctcctttctaaggaa

SEQ ID NO: 439 - DNA, 1519 bp, Clostridium carnis
  ref <308>: DATABASE ACCESSION NUMBER: NCBI ACCESSION: NZ_UYIN01000001.1
  ref <309>: DATABASE ENTRY DATE: 2019-04-01
  ref <313>: RELEVANT RESIDUES IN SEQ ID NO: (1)..(1519)
attgagagtttgatcctggctcaggacgaacgctggcggcgtgcctaacacatgcaagtcgagcgatgaagtttccttcgggaaacggattagcggcggacgggtgagtaacacgtgggtaacctgccttatagtgggggatagcctttcgaaaggaagattaataccgcataagattgtagtatcgcatgatatagcaattaaaggagcaatccgctataagatggacccgcgtcgcattagctagttggtgaggtaatggctcaccaaggcgacgatgcgtagccgacctgagagggtgatcggccacattgggactgagacacggcccagactcctacgggaggcagcagtggggaatattgcacaatgggcgaaagcctgatgcagcaacgccgcgtgagtgatgacggccttcgggttgtaaaactctgtcttcagggacgataatgacggtacctgaggaggaagccacggctaactacgtgccagcagccgcggtaatacgtaggtggcaagcgttgtccggatttactgggcgtaaagggagcgtaggcggatgtttaagtgggatgtgaaatactcgggctcaacttgagtgctgcattccaaactggatatctagagtgcaggagaggaaaggagaattcctagtgtagcggtgaaatgcgtagagattaggaagaataccagtggcgaaggcgcctttctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagctcttcggagcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggccggtacagtaagatgcaataccgtgaggtggagcaaaactcaaaaaccggtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctttctatgga

SEQ ID NO: 440 - DNA, 1520 bp, Clostridium cellulovorans
  ref <308>: DATABASE ACCESSION NUMBER: NCBI ACCESSION: NC_014393.1
  ref <309>: DATABASE ENTRY DATE: 2019-04-01
  ref <313>: RELEVANT RESIDUES IN SEQ ID NO: (1)..(1520)
tttaaattgagagtttgatcctggctcaggacgaacgctggcggcgtgcttaacacatgcaagtcgagcgatgaagcccttcggggtggattagcggcggacgggtgagtaacacgtgggcaacctgccttatagagggggatagccttccgaaaggaagattaataccgcataaaatgcaattctcgcatgagagatgtatcaaaggagcaatccgctataagatgggcccgcggcgcattagctagttggtgaggtaacggctcaccaaggcgacgatgcgtagccgacctgagagggtgatcggccacattggaactgagacacggtccagactcctacgggaggcagcagtggggaatattgcacaatgggggaaaccctgatgcagcaacgccgcgtgagtgatgaaggccttcgggttgtaaagctctttgattagggacgataatgacggtacctaaagaacaagccacggctaactacgtgccagcagccgcggtaatacgtaggtggcaagcgttgtccggatttactgggcgtaaaggatgtgtaggcggatttttaagtgagatgtgaaatacccgagctcaacttgggtgctgcatttcaaactggaagtctagagtgcaggagaggaaagtggaattcctagtgtagcggtgaaatgcgtagagattaggaagaacatcagtggcgaaggcgactttctggactgtaactgacgctgaggcatgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaactggggaagttacctctttgaggtgacaggaagacaggtggtgcatggttgtcgtcagctcgtgtcgtgagatgttgggttaagtcccgcaacgagcgcaacccttattgttagttgctaccatttagttgagcactctagcaagactgcctgggttaaccaggaggaaggtggggatgacgtcaaatcatcatgccccttatgtctagggctacacacgtgctacaatggcgagtacaacgagacgcaagaccgtgaggtggagcaaatctataaaactcgtcccagttcggattgtaggctgaaactcgcctacatgaagttggagttgctagtaatcgcgaatcagcatgtcgcggtgaatacgttcccgggccttgtacacaccgcccgtcacaccatgagagtcggcaacacccgaagtccgtgaggtaaccgtaaggagccagcggccgaaggtggggtcgatgattggggtgaagtcgtaacaaggtagccgtaggagaacctgcggctggatcacctcctttcta

SEQ ID NO: 441 - DNA, 1518 bp, Clostridium cochlearium
  ref <308>: DATABASE ACCESSION NUMBER: NCBI ACCESSION: NZ_UAWC01000008.1
  ref <309>: DATABASE ENTRY DATE: 2019-04-01
  ref <313>: RELEVANT RESIDUES IN SEQ ID NO: (1)..(1518)
tttaaattgagagtttgatcctggctcaggacgaacgctggcggcgtgcttaacacatgcaagtcgagcgatgaagcttcctccgggaagtggattagcggcggacgggtgagtaacacgtgggcaacctgcctcaaagaggggaatagccctccgaaaggaggattaataccgcataaagttagagtttcgcatgaaactttaaccaaaggagtaatctgctttgagatgggcccgcgtcccattagctagttggtaaggtaatggcttaccaaggcaacgatgggtagccgacctgagagggtgatcggccacattggaactgagacacggtccagactcctacgggaggcagcagtggggaatattgcgcaatgggggaaaccctgacgcagcaacgccgcgtgggtgatgaaggttttcggatcgtaaaaccctgttttctgggacgataatgacggtaccagatgaggaagccacggctaactacgtgccagcagccgcggtaatacgtaggtggcaagcgttgtccggatttactgggcgtaaagggtgcgtaggcggatgcttaagtgagatgtgaaatacctaggcttaacttaggggctgcatttcaaactgggcatctagagtacaggagagggaaacggaattcctagtgtagcggtgaaatgcgtagagattaggaagaacaccagtggcgaaggcggtttcctggactgtaactgacgctgaggcacgaaagcgtgggtagcaaacaggattagataccctggtagtccacgccgtaaacgatgaatactaggtgtaggagggtccaaccttctgtgccgcagttaacacattaagtattccgcctggggagtacggtcgcaagactaaaactcaaaggaattgacgggggcccgcacaagcagcggagcatgtggtttaattcgaagcaacgcgaagaaccttacctggacttgacatcccctgaattactcgtaactgaggaaatctcttcggagacagggagacaggtggtgcatggttgtcgtcagctcgtgtcgtgagatgttgggttaagtcccgcaacgagcgcaacccttattattagttgctaccattaagttgagcactctaatgagactgcccgggtgaaccgggaggaaggtggggatgacgtcaaatcatcatgccccttatgtccagggctacacacgtgctacaatggtgggtacagagagaagcgataccgcgaggtggagcaaatctcaaaaacccatcccagttcggattgcaggctgaaactcgcctgcatgaagccggagttgctagtaatcgcaaatcagaatgttgcggtgaatacgttcccgggccttgtacacaccgcccgtcacaccatgagagttggcaacacccgaagtccgtgaggtaaccgtaaggagccagcggccgaaggtggggttaatgattggggtgaagtcgtaacaaggtagccgtaggagaacctgcggctggatcacctcctttcta

SEQ ID NO: 442 - DNA, 1325 bp, Clostridium combesii
  ref <308>: DATABASE ACCESSION NUMBER: NCBI ACCESSION: NZ_PEIK01000031.1
  ref <309>: DATABASE ENTRY DATE: 2019-04-01
  ref <313>: RELEVANT RESIDUES IN SEQ ID NO: (1)..(1325)
catgattttcttatcaaagatttattgctttgagatggacccgcggcgcattagctagttggtaaggtaacggcttaccaaggcaacgatgcgtagccgacctgagagggtgatcggccacattggaactgagacacggtccagactcctacgggaggcagcagtggggaatattgcgcaatgggggaaaccctgacgcagcaacgccgcgtgggtgatgaaggtcttcggattgtaaagccctgttttctaggacgataatgacggtactagaggaggaagccacggctaactacgtgccagcagccgcggtaatacgtaggtggcgagcgttgtccggatttactgggcgtaaagggtgcgtaggcggatgtttaagtgggatgtgaaatccccgggcttaacctgggggctgcattccaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatggatactaggtgtagggggtatcaactccccctgtgccgcagttaacacaataagtatcccgcctggggagtacggtcgcaagattaaaactcaaaggaattgacgggggcccgcacaagcagcggagcatgtggtttaattcgaagcaacgcgaagaaccttacctggacttgacatcccttgcatagcctagagataggtgaagcccttcggggcaaggagacaggtggtgcatggttgtcgtcagctcgtgtcgtgagatgttaggttaagtcctgcaacgagcgcaacccttgttattagttgctaccattaagttgagcactctaatgagactgcctgggtaaccaggaggaaggtggggatgacgtcaaatcatcatgccccttatgtccagggctacacacgtgctacaatggtaggtacaataagacgcaagaccgtgaggtggagcaaaacttataaaacctatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggctggatcacctcctttcta

SEQ ID NO: 443 - DNA, 1419 bp, Clostridium diolis
  ref <308>: DATABASE ACCESSION NUMBER: NCBI ACCESSION: NZ_PRKY01000004.1
  ref <309>: DATABASE ENTRY DATE: 2019-04-01
  ref <313>: RELEVANT RESIDUES IN SEQ ID NO: (1)..(1419)
tttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgtgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcg

SEQ ID NO: 444 - DNA, 1517 bp, Clostridium drakei
  ref <308>: DATABASE ACCESSION NUMBER: NCBI ACCESSION: NZ_CP020953.1
  ref <309>: DATABASE ENTRY DATE: 2019-04-01
  ref <313>: RELEVANT RESIDUES IN SEQ ID NO: (1)..(1517)
ttaaaattgagagtttgatcctggctcaggacgaacgctggcggcgtgcttaacacatgcaagtcgagcgatgaaatctcttcggggatggattagcggcggacgggtgagtaacacgtgggcaacctgcctcaaagtgggggatagccttccgaaagggagattaataccgcataacattagtatttcacatgaattactaattaaaggagtaatccgctttgagatgggcccgcggcgcattagctagttggtgaggtaacggctcaccaaggccacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggttgtaaagctctgtctttggggacgataatgacggtacccaaggaggaagccacggctaactacgtgccagcagccgcggtaatacgtaggtggcgagcgttgtccggatttactgggcgtaaaggatgcgtaggcggatgtttaagtcagatgtgaaaatcccgagcttaacttgggaactgcatttgaaactggatatctagagtgcgggagaggagaatggaattcctagtgtagcggtgaaatgcgtagagattaggaagaacaccagtggcgaaggcgattctctggaccgtaactgacgctgaggcatgaaagcgtgggtagcaaacaggattagataccctggtagtccacgccgtaaacgatgaatactaggtgtaggaggtatcgactccttctgtgccgcagctaacgcaataagtattccgcctgggaagtacgatcgcaagattaaaactcaaaggaattgacgggggcccgcacaagcagcggagcatgtggtttaattcgaagcaacgcgaagaaccttacctagacttgacatcccctgaattacctgtaattagggaagcccttcggggcagggagacaggtggtgcatggttgtcgtcagctcgtgtcgtgagatgttaggttaagtcctgcaacgagcgcaacccttatcattagttgctaccattaagttgagcactctagtgagactgctcgggttaaccgggaggaaggtggggatgacgtcaaatcatcatgccccttatgtctagggctacacacgtgctacaatggtgagtacagaaagatgcaagaccgtgaggtggagcaaaacttttaaaactcatctcagttcggattgtaggctgaaactcgcctacatgaagctggagttgctagtaatcgcgaatcagcatgtcgcggtgaatacgttcccgggccttgtacacaccgcccgtcacaccatgagagctggcaacacccgaagtccgtgaggtaaccgtaaggagccagcggccgaaggtggggttagtaattggggtgaagtcgtaacaaggtagccgtaggagaacctgcggctggatcacctcctttcta

SEQ ID NO: 445 - DNA, 1523 bp, Clostridium fallax
  ref <308>: DATABASE ACCESSION NUMBER: NCBI ACCESSION: NZ_UAVV01000010.1
  ref <309>: DATABASE ENTRY DATE: 2019-04-01
  ref <313>: RELEVANT RESIDUES IN SEQ ID NO: (1)..(1523)
tttaaattgagagtttgatcctggctcaggacgaacgctggcggcgtgcttaacacatgcaagtcgagcgagagagttttcttcggaaaacaatctagcggcggacgggtgagtaacacgtgggtaacctgcctcatagagggggatagcctcccgaaagggagattaataccgcataacatcattttagcgcatgctgaaatgatcaaaggagtaatccgctatgagatggacccgcggcgcattagctagttggtgaggtaacggctcaccaaggccacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtctttagggacgataatgacggtacctaaggaggaagccacggctaactacgtgccagcagccgcggtaatacgtaggtggcaagcgttgtccggatttactgggcgtaaagggagcgtaggtggattcttaagtgagatgtgaaatacccgggcttaacttgggtgctgcatttcaaactgggaatctagagtgcaggagaggaaagtggaattcctagtgtagcggtgaaatgcgtagagattaggaagaacaccagtggcgaaggcgactttctggactgtaactgacactgaggctcgaaagcgtggggagcaaacaggattagataccctggtagtccacgccgtaaacgatggatactaggtgtgggaggtatcaactccttccgtgccgccgttaacacattaagtatcccgcctggggagtacggtcgcaagattaaaactcaaaggaattgacggggacccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtgggggatgacgtcaaatcatcatgccccttatgtctagggctacacacgtgctacaatggctggtacaaagagaagcaagaccgtgaggtggagcaaaactcaaaaaccagtcccagttcggattgtaggctgaaactcgcctacatgaagccggagttgctagtaatcgcgaatcagcatgtcgcggtgaatacgttcccgggtcttgtacacaccgcccgtcacaccatgagagttggcaatacccgaagtctgtgagctaacctgtaaagggggcagcggccgaaggtagggtcagcgattggggtgaagtcgtaacaaggtagccgtaggagaacctgcggctggatcacctcctttcta

SEQ ID NO: 446 - DNA, 246 bp, Clostridium frigidicarnis
  ref <308>: DATABASE ACCESSION NUMBER: NCBI ACCESSION: NZ_FOKI01000074.1
  ref <309>: DATABASE ENTRY DATE: 2019-04-01
  ref <313>: RELEVANT RESIDUES IN SEQ ID NO: (1)..(246)
ttttaaattgagagtttgatcctggctcaggatgaatgctggcggcgtgcttaacacatgcaagtcgagcgagagagtctcttcggaaacaatctagcggcggacgggtgagtaacacgtgggcaacctgccttgtagtgggggatagccctccgaaaggaggattaataccgcatattgtcacattgaggcatctcaaagtgatgaaaggagtaatccgctacaagatgggcccgcggcgcatta

SEQ ID NO: 447 - DNA, 1226 bp, Clostridium gasigenes
  ref <308>: DATABASE ACCESSION NUMBER: NCBI ACCESSION: NZ_FNJM01000043.1
  ref <309>: DATABASE ENTRY DATE: 2019-04-01
  ref <313>: RELEVANT RESIDUES IN SEQ ID NO: (1)..(1226)
cagcaattaaaggagaaatccgctataagatgggcccgcggcgcattagctagttggtgaggtaaaggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaaactctgtctttggggacgataatgacggtacccaaggaggaagccacggctaactacgtgccagcagccgcggtaatacgtaggtggcaagcgttgtccggatttactgggcgtaaagggagcgtaggtggatttttaagtgaggtgtgaaatactcgggctcaacccgagaactgcatttcaaactggaaatctagagtgcaggagaggaaagtggaattcctagtgtagcggtgaaatgcgtagatattaggaagaacaccagtggcgaaggcgactttctggactgtaactgacactgaggctcgaaagcgtggggagcaaacaggattagataccctggtagtccacgccgtaaacgatgaatactaggtgtgggggttgtcatgacctccgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaattggggaagtggcttcggccacaggaagacaggtggtgcatggttgtcgtcagctcgtgtcgtgagatgttgggttaagtcccgcaacgagcgcaacccttattgttagttgccatcatttagttgggcactctagcgagactgcccgggttaaccgggaggaaggtggggatgacgtcaaatcatcatgccccttatgtctagggctacacacgtgctacaatggcaagtacaaagagaagcaagaccgcgaggtggagccaaactataaaacttgtctcagttcggattgcaggctgaaactcgcctgcatgaagctggagttgctagtaatcgcgaatcagcatgtcgcggtgaatacgttcccgggccttgtacacaccgcccgtcacaccacgagagttggcaatacccaaagttcgtgagctaacccg

SEQ ID NO: 448 - DNA, 1519 bp, Clostridium haemolyticum
  ref <308>: DATABASE ACCESSION NUMBER: NCBI ACCESSION: NZ_LSZB01000480.1
  ref <309>: DATABASE ENTRY DATE: 2019-04-01
  ref <313>: RELEVANT RESIDUES IN SEQ ID NO: (1)..(1519)
tttaaattgagagtttgatcctggctcaggacgaacgctggcggcgtgcctaacacatgcaagtcgagcgatgaaacttccttcgggaagtggattagcggcggacgggtgagtaacacgtgggtaacctgcctcaaagagggggatagcctcccgaaagggagattaataccgcataacattattttatggcatcatagaataatcaaaggagtaatccgctttgagatggacccgcggcgcattagctagttggtgaggtaagggctcaccaaggcgacgatgcgtagccgacctgagagggtgatcggccacattggaactgagacacggtccagactcctacgggaggcagcagtgggggaatattgcgcaatgggggaaaccctgacgcagcaacgccgcgtgagtgatgaaggttttcggatcgtaaaactctgtctttagggacgataatgacggtacctaaggaggaagccacggctaactacgtgccagcagccgcggtaatacgtaggtggcaagcgttgtccggatttactgggcgtaaagagtatgtaggtgggtgcttaagtcagatgtgaaattcccgggcttaacctgggcgctgcatttgaaactgggcatctagagtgcaggagaggaaagtggaattcctagtgtagcggtgaaatgcgtagagattaggaagaacaccagtggcgaaggcgactttctggactgtaactgacactgagatacgaaagcgtgggtagcaaacaggattagataccctggtagtccacgccgtaaacgatgaatactaggtgtcggggggtaccaccctcggtgccgcagcaaacgcattaagtattccgcctggggagtacggtcgcaagattaaaactcaaaggaattgacggggacccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctactattaagttaagcactctaacgagactgccgcggttaacgtggaggaaggtggggatgacgtcaaatcatcatgccccttatgtctagggctacacacgtgctacaatggctggtacaacgagcagcaaacccgcgagggggagcaaaacttgaaagccagtcccagttcggattgtaggctgaaactcgcctacatgaagttggagttgctagtaatcgcgaatcagcatgtcgcggtgaatacgttcccgggtcttgtacacaccgcccgtcacaccatgagagccggtaacacccgaagcccgtgaggtaaccgtaaggagccagcggtcgaaggtgggattggtgattggggtgaagtcgtaacaaggtagccgtaggagaacctgcggctggatcacctcctttcta

SEQ ID NO: 449 - DNA, 1516 bp, Clostridium ihumii
  ref <308>: DATABASE ACCESSION NUMBER: NCBI ACCESSION: NZ_CCAT010000051.1
  ref <309>: DATABASE ENTRY DATE: 2019-04-01
  ref <313>: RELEVANT RESIDUES IN SEQ ID NO: (1)..(1516)
tttaaattgagagtttgatcctggctcaggacgaacgctggcggcgtgcctaacacatgcaagtcgagcgatgaaattccttcgggaatggattagcggcggacgggtgagtaacacgtgggtaacctgcctcatagaggggaatagccttccgaaaggaagattaataccgcataatgtagtaccttcgcatgaaggaactatcaaaagagcaatctgctatgagatggacccgcggcgcattagctagttggtgaggtaacggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttcgggttgtaaagttctgtcttatgggaagataatgacggtaccataggaggaagccacggctaactacgtgccagcagccgcggtaatacgtaggtggcaagcgttgtccggatttactgggcgtaaaggatgcgtaggcggatatttaagtgggatgtgaaatacctgagctcaactcgggtgctgcattccaaactggatatctagagtgtcggaggggaaagcggaattcctagtgtagcggtgaaatgcgtagagattaggaagaacaccagtggcgaaggcggctttctggacgataactgacgctgaggcatgaaagcgtggggagcaaacaggattagataccctggtagtccacgccgtaaacgatgaatactaggtgtaggaggtatcgactccttctgtgccgcagttaacacattaagtattccgcctggggagtacgatcgcaagattaaaactcaaaggaattgacgggggcccgcacaagcagcggagcatgtggtttaattcgaagcaacgcgaagaaccttacctagacttgacatcccctgaatcactcttaatcgaggaagtccttcgggacagggagacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtaggtacaaatagacgcaataccgcgaggtggagcaaaactctaaaacctatcccagttcggattgcaggctgcaactcgcctgcatgaagccggagttgctagtaatcgcgaatcagcatgtcgcggtgaatacgttcccgggccttgtacacaccgcccgtcacaccatgagagccgataacacccgaagtccgtgaggtaaccgtaaggagccagcggccgaaggtgggattggtgattggggtgaagtcgtaacaaggtagccgtaggagaacctgcggctggatcacctcctttcta

SEQ ID NO: 450 - DNA, 1515 bp, Clostridium isatidis
  ref <308>: DATABASE ACCESSION NUMBER: NCBI ACCESSION: NZ_CP016786.1
  ref <309>: DATABASE ENTRY DATE: 2019-04-01
  ref <313>: RELEVANT RESIDUES IN SEQ ID NO: (1)..(1515)
gtgagagtttgatcctggctcaggacgaacgctggcggcgtgcctaacacatgcaagtcgagcgaggtgatttccttcgggaatgaacctagcggcggacgggtgagtaacacgtgggcaacctgccttatagaggggaatagcctcccgaaagggagattaataccgcataatattgaagcttcgcatgaagcttcaatcaaaggagcaatccgctataagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggacttttaagtgagatgtgaaatactcgggctcaacccgggggctgcatttcaaactgaaagtctagagtgcaggagaggagagtggaattcctagtgtagcggtgaaatgcgtagagattaggaagaacaccagtggcgaaggcggctctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattacccttaaccggggaagtcccttcggggacaggatgacaggtggtgcatggttgtcgtcagctcgtgtcgtgagatgttgggttaagtcccgcaacgagcgcaacccctattgttagttgccaccattaagttgagcactctagcgagactgcccgggttaaccgggaggaaggtggggatgacgtcaaatcatcatgccccttatgtctagggctacacacgtgctacaatggcaagtacaacgagatgcaataccgcgaggtggagctaacctataaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagtccgtgagctaacccgtaagggaggcagcggcctaaggtagggtcagcgattggggtgaagtcgtaacaaggtagccgtaggagaacctgcggctggatcacctcctttcta

SEQ ID NO: 451 - DNA, 1522 bp, Clostridium liquoris
  ref <308>: DATABASE ACCESSION NUMBER: NCBI ACCESSION: NZ_PVXO01000049.1
  ref <309>: DATABASE ENTRY DATE: 2019-04-01
  ref <313>: RELEVANT RESIDUES IN SEQ ID NO: (1)..(1522)
tttaaattgagagtttgatcctggctcaggacgaacgctggcggcgtgcctaacacatgcaagtcgagcgatgaagttccttcgggaatggattagcggcggacgggtgagtaacacgtgggtaacctgcctcaaagtgggggatagccctccgaaaggaggattaataccgcataaagttaagcttccgcatgggagcataaccaaaggagtaatccgctttgagatggacccgcggtgcattagctagttggtgaggtaacggctcaccaaggccacgatgcatagccgacctgagagggtgatcggccacattggaactgagatacggtccagactcctacgggaggcagcagtggggaatattgcgcaatgggggaaaccctgacgcagcaacgccgcgtgggtgatgaaggtcttcggattgtaaaaccctgtcttctgggacgataatgacggtaccagaggaggaagccacggctaactacgtgccagcagccgcggtaatacgtaggtggcgagcgttgtccggatttactgggcgtaaaggatgcgtaggcggatatttaagtcagatgtgaaatacccgagcttaacttgggtgctgcatttgaaactgggtatctagagtgcaggagaggtaagtggaattcctagtgtagcggtgaaatgcgtagagattaggaagaacaccagtggcgaaggcgacttactggactgtaactgacgctgaggcatgaaagcgtgggtagcaaacaggattagataccctggtagtccacgccgtaaacgatgaatactaggtgtaggaggtatcgactccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatcccctgaattactcgtaactgaggaagcccttcggggcagggagacaggtggtgcatggttgtcgtcagctcgtgtcgtgagatgttgggttaagtcccgcaacgagcgcaacccttatcattagttgctaccaaattatgttgagcactctaatgagaccgcccgggttaaccgggaggaaggtggggatgacgtcaaatcatcatgccccttatgtctagggctacacacgtgctacaatggtgagtacagaaagatgcaatcccgtgagggggagcaaaactcaaaaacttatcccagttcggattgtaggctgaaactcgcctacatgaagccggagttgctagtaatcgcgaatcagcatgtcgcggtgaatacgttcccgggccttgtacacaccgcccgtcacaccatgagagttggcaacacccgaagtccgtgaggtaaccgtaaggagccagcggccgaaggtggggttaataattggggtgaagtcgtaacaaggtagccgtaggagaacctgcggctggatcacctcctttctaagga

SEQ ID NO: 452 - DNA, 1252 bp, Clostridium luticellarii
  ref <308>: DATABASE ACCESSION NUMBER: NCBI ACCESSION: NZ_PVXP01000153.1
  ref <309>: DATABASE ENTRY DATE: 2019-04-01
  ref <313>: RELEVANT RESIDUES IN SEQ ID NO: (1)..(1252)
ggcttaccaaggcaacgatgcgtagccgacctgagagggtgaacggccacattggaactgagagacggtccagactcctacgggaggcagcagtggggaatattgcacaatgggcgaaagcctgatgcagcaacgccgcgtgagtgaagaaggttttcggattgtaaagctctgtcatctgggacgataatgacggtaccagatgaggaagccacggctaactacgtgccagcagccgcggtaatacgtaggtggcaagcgttgtccggaattactgggcgtaaagggtgcgcaggcggacatttaagtgagatgtgaaagacccgggcttaacttgggcagtgcatttcaaactggatgtctggagtgcaggagaggagaacggaattcctagtgtagcggtgaaatgcgtagagattaggaagaacaccagtggcgaaggcggttctctggactgtaactgacgctgaggcacgaaagcgtgggtagcaaacaggattagataccctggtagtccacgccgtaaacgatgagtactaggtgtaggaggtatcgaccccttctgtgccgcagtaaacacaataagtactccgcctgggaagtacgatcgcaagattaaaactcaaaggaattgacgggggcccgcacaagcagcggagcatgtggtttaattcgaagcaacgcgaagaaccttacctggacttgacatcccctgcatatcttagagataagagaagcccttcggggcagggagacaggtggtgcatggttgtcgtcagctcgtgtcgtgagatgttaggttaagtcctgcaacgagcgcaacccctattgttagttgctagcagtaagatgagcactctaacgagacagccgcggttaacgcggaggaaggtggggatgacgtcaaatcatcatgccccttatgtccagggcaacacacgtgctacaatgggcagaacagagagaagcaagaccgcgaggtggagcgaaccttgaaaactgctcccagttcggattgcaggctgaaacccgcctgcatgaagctggagttgctagtaatcgcgaatcagcatgtcgcggtgaatacgttcccgggccttgtacacaccgcccgtcacaccatgagagctggcaacacccgaagtccgtagtctaacgaaagaggacgcggccgaaggtggggttagtgattggggtgaagtcgtaacaaggtagccgtaggagaacctgcggctggatcacctcctttcta

SEQ ID NO: 453 - DNA, 1520 bp, Clostridium mediterraneense
  ref <308>: DATABASE ACCESSION NUMBER: NCBI ACCESSION: NZ_LT594785.1
  ref <309>: DATABASE ENTRY DATE: 2019-04-01
  ref <313>: RELEVANT RESIDUES IN SEQ ID NO: (1)..(1520)
ttttaaattgagagtttgatcctggctcaggatgaacgctggcggcgtgcctaacacatgcaagtcgagcgatgaagtttccttcggggaacggattagcggcggacgggtgagtaacacgtgggtaacctgcctcatagaggggaatagccttccgaaaggaagattaataccgcataatattatcgagtggcatcacttgataatcaaaggagcaatccgctatgagatggacccgcgtcgcattagttagttggtggggtaacggcctaccaagacgacgatgcgtagccgacctgagagggtgatcggccacattgggactgagacacggcccagactcctacgggaggcagcagtggggaatattgcacaatggaggaaactctgatgcagcaacgccgcgtgagcgatgaaggtcttcggatcgtaaagctctgtctttagggatgataatgacagtacctaaggaggaagccacggctaactacgtgccagcagccgcggtaatacgtaggtggcgagcgttatccggatttattgggcgtaaagggagcgtaggcggatacttaagtgggatgtgaaatacttgggctcaacccgagtactgcattccaaactgagtatctagagtgcaggagaggagagtggaattcctagtgtagcggtgaaatgcgtagagattaggaagaacaccagtggcgaaggcgactctctggactgtaactgacgctgaggctcgaaagcgtggggagcgaacaggattagataccctggtagtccacgccgtaaacgatgaatactaggtgtaggggtttcgatacctctgtgccgccgctaacgcattaagtattccgcctggggagtacggtcgcaagattaaaactcaaaggaattgacggggacccgcacaagcagcggagcatgtggtttaattcgaagcaacgcgaagaaccttacctacacttgacatcccttgcattacccttaatcggggaaatctcttcggagacaaggtgacaggtggtgcatggttgtcgtcagctcgtgtcgtgagatgttgggttaagtcccgcaacgagcgcaacccctattgttagttgctaccattaagttgagcactctagcgagactgcctgggttaaccaggaggaaggtggggacgacgtcaaatcatcatgccccttatgtgtagggctacacacgtgctacaatggcaggtacagagagacgcaagaccgtgaggtggagcaaatcccacaaaacctgtcccagttcggattgaaggctgaaactcgccttcatgaagccggagttgctagtaatcgcgaatcagaatgtcgcggtgaatacgttcccgggtcttgtacacaccgcccgtcacaccatgagagttggcaatacccaacgtccgtgagctaaccgcaaggaggcagcggcctaaggtagggtcagcgattggggtgaagtcgtaacaaggtagccgtaggagaacctgcggctggatcacctcctttcta

SEQ ID NO: 454 - DNA, 1525 bp, Clostridium minihomine
  ref <308>: DATABASE ACCESSION NUMBER: NCBI ACCESSION: NZ_OEQH01000011.1
  ref <309>: DATABASE ENTRY DATE: 2019-04-01
  ref <313>: RELEVANT RESIDUES IN SEQ ID NO: (1)..(1525)
ttttagagagtttgatcctggctcaggacgaacgctggcggcatgcctaacacatgcaagtcgaacggagtaagagataagcttgcttaactcttacttagtggcggacgggtgagtaacgcgtgagtaacctgcctttcagagggggataacgttctgaaaagaacgctaataccgcatgatatatcggtgtcgcatggcactgatatcaaaggagcaatccgctgaaagatggactcgcgtccgattagccagttggcggggtaatggcccaccaaagcgacgatcggtagccgggttgagagactggacggccacattgggactgagacacggcccagactcctacgggaggcagcagtgggggatattgcacaatggaggaaactctgatgcagcaatgccgcgtgagggaagacggtcttcggattgtaaacctctgtccttggtgaagataatgacggtagccaaggaggaagctccggctaactacgtgccagcagccgcggtaatacgtagggagcaagcgttgtccggatttactgggtgtaaagggtgcgtaggcggcttttcaagtcgggcgtgaaagctgtgggcttaacccacaaattgcgttcgaaactggagagcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggtctgaccccttccgtgccggagttaacacaataagtaatccacctggggagtacggccgcaaggctgaaactcaaaggaattgacgggggcccgcacaagcagtggagtatgtggtttaattcgaagcaacgcgaagaaccttaccaggtcttgacatccaactaacgaagcagagatgcattaggtgcccttcggggaaagttgagacaggtggtgcatggttgtcgtcagctcgtgtcgtgagatgttgggttaagtcccgcaacgagcgcaacccctgtgattagttgctacgcaagagcactctaatcagactgccgttgacaaaacggaggaaggtggggacgacgtcaaatcatcatgccccttatgacctgggctacacacgtactacaatggtcgttaacaacgggaagctaagccgcgaggtggcgcaaatccccaaaaacggtctcagttcggattgtaggctgcaacccgcctacatgaagttggaattgctagtaatcgcggatcagcatgccgcggtgaatacgttcccgggccttgtacacaccgcccgtcacaccacgggagccggtaatacccgaagccgatagtctaaccgcaaggaggacgtcgtcgaaggtaggattggcgactggggtgaagtcgtaacaaggtagccgtatcggaaggtgcggctggatcacctcctttctatgga

SEQ ID NO: 455 - DNA, 1524 bp, Clostridium neonatale
  ref <308>: DATABASE ACCESSION NUMBER: NCBI ACCESSION: NZ_PDCJ01000002.1
  ref <309>: DATABASE ENTRY DATE: 2019-04-01
  ref <313>: RELEVANT RESIDUES IN SEQ ID NO: (1)..(1524)
tttttattgagagtttgatcctggctcaggacgaacgctggcggcgtgcctaacacatgcaagtcgagcgatgaagtttccttcgggaaatggattagcggcggacgggtgagtaacacgtgggtaacctgccttatagtgggggatagcctttcgaaaggaagattaataccgcataagattgtagtatcgcatgatatagcaattaaaggagcaattcgctataagatggacccgcgtcgcattagctagttggtgaggtaatggctcaccaaggcgacgatgcgtagccgacctgagagggtgatcggccacattgggactgagacacggcccagactcctacgggaggcagcagtggggaatattgcacaatgggcgaaagcctgatgcagcaacgccgcgtgagtgatgacggccttcgggttgtaaaactctgtcttcagggacgataatgacggtacctgaggaggaagccacggctaactacgtgccagcagccgcggtaatacgtaggtggcaagcgttgtccggatttactgggcgtaaagggagcgtaggcggatgtttaagtgggatgtgaaatactcgggctcaacttgagtgctgcattccaaactggatatctagagtgcaggagaggaaaggagaattcctagtgtagcggtgaaatgcgtagagattaggaagaataccagtggcgaaggcgcctttctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagctcttcggagcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggccggtacagtaagatgcaataccgtgaggtggagcaaaactcaaaaaccggtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctttctatgga

SEQ ID NO: 456 - DNA, 1516 bp, Clostridium nigeriense
  ref <308>: DATABASE ACCESSION NUMBER: NCBI ACCESSION: NZ_LT575472.1
  ref <309>: DATABASE ENTRY DATE: 2019-04-01
  ref <313>: RELEVANT RESIDUES IN SEQ ID NO: (1)..(1516)
attgagagtttgatcctggctcaggacgaacgctggcggcgtgcctaacacatgcaagtcgagcgaggggagtttcttcggaaacaaacctagcggcggacgggtgagtaacacgtgggcaacctgccttatagtggggaatagcctctcgaaagggagattaataccgcataacattgcactttcgcatgaaagagcaattaaaggagcaatccgctataagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggtcttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggacttttaagtgagatgtgaaatacccgagctcaacttgggggctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattactcttaatcgaggaagtcctttcggggacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaacgagatgcaataccgcaaggtggagctaaactataaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcgacctaaggtagggtcagcgattggggtgaagtcgtaacaaggtagccgtaggagaacctgcggctggatcacctcctttcta

SEQ ID NO: 457 - DNA, 1518 bp, Clostridium novyi
  ref <308>: DATABASE ACCESSION NUMBER: NCBI ACCESSION: NZ_CP029458.1
  ref <309>: DATABASE ENTRY DATE: 2019-04-01
  ref <313>: RELEVANT RESIDUES IN SEQ ID NO: (1)..(1518)
tttaaattgagagtttgatcctggctcaggacgaacgctggcggcgtgcctaacacatgcaagtcgagcgatgaaacttccttcggggagtggattagcggcggacgggtgagtaacacgtgggtaacctgcctcaaagagggggatagcctcccgaaagggagattaataccgcataacattattttatggcatcataaaataatcaaaggagcaatccgctttgagatggacccgcggcgcattagctagttggtgaggtaagggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagtgatgaaggttttcggatcgtaaaactctgtctttagggacgataatgacggtacctaaggaggaagccacggctaactacgtgccagcagccgcggtaatacgtaggtggcaagcgttgtccggatttactgggcgtaaagagtatgtaggtgggtgcttaagtcagatgtgaaattcccgggcttaacctgggcgctgcatttgaaactgggcatctagagtgcaggagaggaaagtggaattcctagtgtagcggtgaaatgcgtagagattaggaagaacaccagtggcgaaggcgactttctggactgtaactgacactgagatacgaaagcgtgggtagcaaacaggattagataccctggtagtccacgccgtaaacgatgaatactaggtgtcggggggtaccaccctcggtgccgcagcaaacgcattaagtattccgcctggggagtacggtcgcaagattaaaactcaaaggaattgacggggacccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctactattaagttaagcactctaacgagactgccgcggttaacgtggaggaaggtggggatgacgtcaaatcatcatgccccttatgtctagggctacacacgtgctacaatggctggtacaacgagcagcaaacccgcgagggggagcaaaacttgaaagccagtcccagttcggattgtaggctgaaactcgcctacatgaagttggagttgctagtaatcgcgaatcagcatgtcgcggtgaatacgttcccgggtcttgtacacaccgcccgtcacaccatgagagccggtaacacccgaagcccgtgaggtaaccgtaaggagccagcggtcgaaggtgggattggtgattggggtgaagtcgtaacaaggtagccgtaggagaacctgcggctggatcacctcctttcta

SEQ ID NO: 458 - DNA, 1529 bp, Clostridium paraputrificum
  ref <308>: DATABASE ACCESSION NUMBER: NCBI ACCESSION: NZ_UAWK01000013.1
  ref <309>: DATABASE ENTRY DATE: 2019-04-01
  ref <313>: RELEVANT RESIDUES IN SEQ ID NO: (1)..(1529)
tttgtggagagtttgatcctggctcaggacgaacgctggcggcgtgcttaacacatgcaagtcgaacggtaaggccccagcttgctggggtacacgagtggcgaacgggtgagtaacacgtgggtgacctgccccgcacttcgggataagcctgggaaaactgggtctaataccggataggaccgcaccgtgagggtgtggtggaaagtttttcggtgtgggatgggcccgcggcctatcagcttgttggtggggtaatggcctaccaaggcggcgacgggtagccggcctgagagggtggacggccacattgggactgagacacggcccagactcctacgggaggcagcagtggggaatattgcacaatgggcggaagcctgatgcagcgacgccgcgtgggggatgacggccttcgggttgtaaactcctttcaccatcgacgaaggttttctgacggtagatggagaagaagcaccggctaactacgtgccagcagccgcgggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatgggtagcgaacaggattagataccctggtagtccatgccgtaaacggtgggcgctaggtgtaggggtcttccacgacttctgtgccgtagctaacgcattaagcgccccgcctggggagtacggccgcaaggctaaaactcaaaggaattgacggggcccgcacaagcggcggagcatgtggattaattcgatgcaacgcgaagaaccttacctgggcttgacatatacgggaccgggccagagatggtccttcccttgtggctcgtatacaggtggtgcatggttgtcgtcagctcgtgtcgtgagatgttgggttaagtcccgcaacgagcgcaacccttgttcttatgttgccagcacgtaatggtggggactcgtgagaaaactgccggggtcaactcggaggaaggtgggatgacgtcaaatcatcatgccccttatgtccagggcttcacacatgctacaatggtcggtacagtgggttgcgatgccgtgaggtggagctaatccctgaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcccaacccttgtggggggagctgtcgaaggtgggatcggcgattgggacgaagtcgtaacaaggtagccgtaccggaaggtgcggctggatcacctcctttctaaggag

SEQ ID NO: 459 - DNA, 1253 bp, Clostridium peptidivorans
  ref <308>: DATABASE ACCESSION NUMBER: NCBI ACCESSION: NZ_OAOD01000051.1
  ref <309>: DATABASE ENTRY DATE: 2019-04-01
  ref <313>: RELEVANT RESIDUES IN SEQ ID NO: (1)..(1253)
ggctcaccaaggcaacgatgcgtagccgacctgagagggtgatcggccacattggaactgagatacggtccagactcctacgggaggcagcagtggggaatattgcgcaatgggggaaaccctgacgcagcaacgccgcgtgggtgaagaaggccttcgggttgtaaagctctgtcttctgggacgataatgacggtaccagaggaggaagccacggctaactacgtgccagcagccgcggtaatacgtaggtggcaagcgttgtccggatttactgggcgtaaagggagcgtaggcggatatttaagtcagatgtgaaatacccgagcttaacttgggtgctgcatttgaaactggatatctggagtgcaggagaggaaagtggaattcctagtgtagcggtgaaatgcgtagagattaggaagaacaccagtggcgaaggcgactttctggactgtaactgacgctgaggctcgaaagcgtggggagcaaacaggattagataccctggtagtccacgccgtaaacgatgaatactaggtgtaggaggtatcgaccccttctgtgccgcagttaacacaataagtattccgcctggggagtacggtcgcaagattaaaactcaaaggaattgacgggggcccgcacaagcagcggagcatgtggtttaattcgaagcaacgcgaagaaccttacctagacttgacatcccctgaattactcgtaacggaggaagcccttcggggcagggagacaggtggtgcatggttgtcgtcagctcgtgtcgtgagatgttgggttaagtcccgcaacgagcgcaacccttatcattagttgctaccattaagttgagcactctaatgagactgcccgggttaaccgggaggaaggtggggatgacgtcaaatcatcatgccccttatgtctagggctacacacgtgctacaatggttggtacaaagagatgcaagaccgtgaggtggagcaaaactcaaaaaccaatcccagttcggattgtaggctgaaactcgcctacatgaagccggagttgctagtaatcgcgaatcagcatgtcgcggtgaatacgttcccgggccttgtacacaccgcccgtcacaccatgagagttggcaacacccgaagtccgtgaggtaaccgtaaggagccagcggccgaaggtggggtcaatgattggggtgaagtcgtaacaaggtagccgtaggagaacctgcggctggatcacctcctttcta

SEQ ID NO: 460 - DNA, 1253 bp, Clostridium perfringens
  ref <308>: DATABASE ACCESSION NUMBER: NCBI ACCESSION: NZ_UWOU01000001.1
  ref <309>: DATABASE ENTRY DATE: 2019-04-01
  ref <313>: RELEVANT RESIDUES IN SEQ ID NO: (1)..(1253)
ggcctaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtctttggggaagataatgacggtacccaaggaggaagccacggctaactacgtgccagcagccgcggtaatacgtaggtggcgagcgttatccggatttactgggcgtaaagggagcgtaggcggatgattaagtgggatgtgaaatacccgggctcaacttgggtgctgcattccaaactggttatctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtgggggtttcaacacctccgtgccgccgctaacgcattaagtattccgcctggggagtacggtcgcaagattaaaactcaaaggaattgacggggacccgcacaagtagcggagcatgtggtttaattcgaagcaacgcgaagaaccttacctacacttgacatcccttgcattactcttaatcgaggaaatcccttcggggacaaggtgacaggtggtgcatggttgtcgtcagctcgtgtcgtgagatgttgggttaagtcccgcaacgagcgcaacccttgtcgttagttactaccattaagttgaggactctagcgagactgcctgggttaaccaggaggaaggtggggatgacgtcaaatcatcatgccccttatgtgtagggctacacacgtgctacaatggctggtacagagagatgcaataccgcgaggtggagccaaacttaaaaaccagtctcagttcggattgtaggctgaaactcgcctacatgaagctggagttactagtaatcgcgaatcagaatgtcgcggtgaatacgttcccgggtcttgtacacaccgcccgtcacaccatgagagttggcaatacccgaagtccgtgagctaaccgcaaggaggcagcggccgaaggtagggtcagcgattggggtgaagtcgtaacaaggtagccgtaggagaacctgcggctggatcacctcctttcta

SEQ ID NO: 461 - DNA, 1521 bp, Clostridium putrefaciens
  ref <308>: DATABASE ACCESSION NUMBER: NCBI ACCESSION: NZ_UFWZ01000001.1
  ref <309>: DATABASE ENTRY DATE: 2019-04-01
  ref <313>: RELEVANT RESIDUES IN SEQ ID NO: (1)..(1521)
tttaaattgagagtttgatcctggctcaggacgaacgctggcggcgtgcttaacacatgcaagtcgagcgaagttattccttcgggaataacttagcggcggacgggtgagtaacacgtgggtaacctgcctcatagagggggatagccttccgaaaggaagattaataccccataacatagcattatcgcatgataaagttattaaaggagtaatccgctatgagatggacccgcggcgcattagctagttggtgaggtaacggctcaccaaggccacgatgcgtagccgacctgagagggtgatcggccacattgggactgagacacggcccagactcctacgggaggcagcagtggggaatattgcacaatgggcgaaagcctgatgcagcaacgccgcgtgagtgatgaaggccttcgggtcgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatacttaagtgggatgtgaaatacccgggctcaacccgggtgctgcattccaaactgggtatctagagtgtgggagaggaaagtggaattcctagtgtagcggtgaaatgcgtagatattaggaagaacaccagtggcgaaggcgactttctggaccataactgacgctgaggctcgaaagcgtggggagcaaacaggattagataccctggtagtccacgccgtaaacgatggatactaggtgtgggggataccaatcctccgtgccgtcgttaacacactaagtatcccgcctggggagtacgatcgcaagattaaaactcaaaggaattgacgggggcccgcacaagcagcggagcatgtggtttaattcgaagcaacgcgaagaaccttacctagacttgacatctcctgaattacctgtaattagggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcctgggttaaccaggaggaaggtggggatgacgtcaaatcatcatgccccttatgtctagggctacacacgtgctacaatggcgagtacaacgagacgcaataccgcgaggtggagcaaaactcaaaaaactcgtcccagttcggattgtaggctgaaactcgcctacatgaagccggagttgctagtaatcgcgaatcagaatgtcgcggtgaatacgttcccgggccttgtacacaccgcccgtcacaccatgagagttggcaatacccgaagtccgtgtgctaacgcgtaagcgaggcagcggccgaaggtagggtcagcgattggggtgaagtcgtaacaaggtagccgtaggagaacctgcggctggatcacctcctttctatgga

SEQ ID NO: 462 - DNA, 375 bp, Clostridium sp. 1xD42-85
  ref <308>: DATABASE ACCESSION NUMBER: NCBI ACCESSION: NZ_RAYN01000126.1
  ref <309>: DATABASE ENTRY DATE: 2019-04-01
  ref <313>: RELEVANT RESIDUES IN SEQ ID NO: (1)..(375)
tttagacgagagtttgatcctggctcaggatgaacgctggcggcgtgcctaacacatgcaagtcgagcgaagcgcttgaatctgattcttcggatgaggattcttgtgactgagcggcggacgggtgagtaacgcgtgggcaacctgccttacacagggggataacagttagaaatgactgctaataccgcataagaccgcagtaccgcatggtacagcggtaaaaactccggtggtgtaagatgggcccgcgtctgattaggtagttggcggggtaacggcccaccaagccgacgatcagtagccgacctgagagggtgaccggccacattgggactgagacacggcccagactcctacgggaggcagcagtgg

SEQ ID NO: 463 - DNA, 1658 bp, Clostridium sp. 2-1
  misc_feature (327)..(327): n is a, c, g, or t
  misc_feature (885)..(885): n is a, c, g, or t
  misc_feature (1400)..(1400): n is a, c, g, or t
  ref <308>: DATABASE ACCESSION NUMBER: NCBI ACCESSION: NZ_PQCR01000159.1
  ref <309>: DATABASE ENTRY DATE: 2019-04-01
  ref <313>: RELEVANT RESIDUES IN SEQ ID NO: (1)..(1658)
ttttagagagtttgatcctggctcaggacgaacgctggcggcgtgcctaacacatgcaagtcgaacggagccattgataagcttgcttaaagatggtttagtggcggacgggtgagtaacgcgtgaggaacctgcctttcagagggggataacgtctggaaacggacgctaataccgcatgacatatcgagatcacatggttttgatatcaaaggagcaatccgctgaaagatggactcgcgtccgattagccagttggcggggtaacggcccaccaaagcgacgatcggtagccggactgagaggttgaacggccacattgggacnatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtgggggatattgcacaatggaggaaactctgatgcagcaacgccgcgtgagggaagaaggttttcggattgtaaacctctgtcctcggtgacgaaacaaatgacggtagccgaggaggaagctccggctaactacgtgccagcagccgcggtaatacgtagggagcaagcgttgtccggatttactgggtgtaaagggtgcgtaggcggctctgcaagtcaggcgtgaaaactatgggcttaactcatagactgcgtttgaaactgtggggcttgagtgaagtagaggtaggcggaattcccggtgtagcggtgaaatgcgtagagatcgggaggaacaccagtggcgaaggcggcctactgggctttaactgacgctgaagcacgaaagcatgggtntaccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgtgattagttgctacgcaagagcactctaatcagactgccgttgacaaaacggaggaaggtggggacgacgtcaaatcatcatgccctttatgacctgggctacacacgtactacaatggccgttaacagagggaagcaagaccgcgaggtggagcaaaaccctaaaaacggtcccagttcggattgnaaaccagtctcagttcggattgtaggctgaaactcgcctacatgaagctggagttgctagtaatcgcgaatcagaatgtcgcggtgaatacgttcccgggccttgtacacaccgcccgtcacaccatgggagccggtaatacccgaagtcagtagtctaaccgcaagggggacgctgccgaaggtaggattggcgactggggtgaagtcgtaacaaggtagccgtatcggaaggtgcggctggatcacctcctttcta

SEQ ID NO: 464 - DNA, 375 bp, Clostridium sp. 3-3
  ref <308>: DATABASE ACCESSION NUMBER: NCBI ACCESSION: NZ_PQCS01000337.1
  ref <309>: DATABASE ENTRY DATE: 2019-04-01
  ref <313>: RELEVANT RESIDUES IN SEQ ID NO: (1)..(375)
gcagccgcggtaatacgtagggggcaagcgttatccggatttactgggtgtaaagggagcgtagacggcactgcaagtctggagtgaaagcccggggctcaaccccgggactgctttggaaactgtggtgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgt

SEQ ID NO: 465 - DNA, 1541 bp, Clostridium sp. 7 3 54FAA
  ref <308>: DATABASE ACCESSION NUMBER: NCBI ACCESSION: NZ_JH376533.1
  ref <309>: DATABASE ENTRY DATE: 2019-04-01
  ref <313>: RELEVANT RESIDUES IN SEQ ID NO: (1)..(1541)
ttaaacatgagagtttgatcctggctcaggatgaacgctggcggcgtgcctaacacatgcaagtcgaacgaagcgatttaacggaagttttcggatggaagttgaattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagacaggtggtgcatggttgtcgtcagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttctaaggaa

SEQ ID NO: 466 - DNA, 1541 bp, Clostridium sp. AF02-29
  ref <308>: DATABASE ACCESSION NUMBER: NCBI ACCESSION: NZ_QUHX01000004.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcaatctaacggaagttttcggatggaagctggattgactgagtggcggacgggtgagtaacgcgtgggtaacctgcctcacactgggggacaacagttagaaatgactgctaataccgcataagcgcacaggaccgcatggtctagtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgcaaggagggagctgccgaaggcaggaccgataactggggtgaagtcgtaacaaggtagccgtatcggaaggtgcggctggatcacctcctttctaaggaa

SEQ ID NO: 467 - DNA, 1541 bp, Clostridium sp. AF12-19
  ref <308>: DATABASE ACCESSION NUMBER: NCBI ACCESSION: NZ_QUHQ01000001.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcctaacacatgcaagtcgaacgaggtaaataagttgaagttttcggatggattcttatttaccgagtggcggacgggtgagtaacgcgtgggtaacctgcctcatacagggggataacggttagaaatgactgctaataccgcataagcgcacagtaccgcatggtacggtgtgaaaaactccggtggtatgagatggacccgcgtctgattagctagttggtgaggtaacggcccaccaaggcgacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaaagcctttaatcgggctcctccttcgggacagaggtgacaggtggtgcatggttgtcgtcagctcgtgtcgtgagatgttgggttaagtcccgcaacgagcgcaacccctattgtcagtagccagcaggtaaagctgggaactctgatgagactgccagggataacctggaggaaggtggggatgacgtcaaatcatcatgccccttatgatttgggctacacacgtgctacaatggcgtaaacaaagagaagcgagcctgcgagggggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctcctttctaaggaa

SEQ ID NO: 468 - DNA, 1480 bp, Clostridium sp. AF12-28
  ref <308>: DATABASE ACCESSION NUMBER: NCBI ACCESSION: NZ_QUHP01000004.1
  ref <309>: DATABASE ENTRY DATE: 2019-04-01
  ref <313>: RELEVANT RESIDUES IN SEQ ID NO: (1)..(1480)
tttaacatgagagtttgatcctgtctcaggatgaacgctggcggcgtgcctaacacatgcaagtcgaacgaggcattttgattgaagttttcggatggatttcaagttaccgagtggcggacgggtgggtaacgcgtgggtaacctgcctcatacagggggataacggttagaaatgactgctaataccgcataagcgcacagtaccgcatggtacggtgtgaaaaactccggtggtatgagatggacccgcgtctgattagctagttggtgaggtaacggcccaccaaggcgacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaaagcctttaatcgggctcctccttcgggacagaggtgacaggtggtgcatggttgtcgtcagctcgtgtcgtgagatgttgggttaagtcccgcaacgagcgcaacccctattgtcagtagccagcaggtaaagctgggcactctgatgagactgccagggataacctggaggaaggtggggatgacgtcaaatcatcatgccccttatgatttgggctacacacgtgctacaatggcgtaaacaaagagaagcgagcctgcgagggggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccagtgacccaagcgaaagcagggagctgtcgaaggcaggtctgataactgggg

SEQ ID NO: 469 - DNA, 1536 bp, Clostridium sp. AF12-41
  ref <308>: DATABASE ACCESSION NUMBER: NCBI ACCESSION: NZ_QTXO01000006.1
  ref <309>: DATABASE ENTRY DATE: 2019-04-01
  ref <313>: RELEVANT RESIDUES IN SEQ ID NO: (1)..(1536)
tttaacatgagagtttgatcctggcgcaggatgaacgctggcggcgtgcttaacacatgcaagtcgaacgaagcaatctaacggaagttttcggatggaagttaaattgactgagtggcggacgggcgagtaacgcgtgggtaacctgcctcacactggggggcaacagttagaaatgactgctaataccgcataagcgcacaggaccgcatggtccggtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgtaaggagggagctgccgaaggcaggaccgataactggggtgaagtcgtaacaaggtagccgtatcggaaggtgcggctggatcacctcctttcta

SEQ ID NO: 470 - DNA, 1542 bp, Clostridium sp. AF15-17LB
  ref <308>: DATABASE ACCESSION NUMBER: NCBI ACCESSION: NZ_QRYR01000008.1
  ref <309>: DATABASE ENTRY DATE: 2019-04-01
  ref <313>: RELEVANT RESIDUES IN SEQ ID NO: (1)..(1542)
ttaagacgagagtttgatcctggctcaggatgaacgctggcggcgtgcttaacacatgcaagtcgagcgaagcgccttatacagattccttcgggatgaaggatttggcgactgagcggcggacgggtgagtaacgcgtgggcaacctgcctcacacagggggataacagctagaaatggctgctaataccgcataaggccgcggcaccgcatggtgcggcggcagaagctccggcggtgtgagatgggcccgcgtctgattaggtagttggtgcggtaacggcgcaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcagggcaagtctggagtgaaagcccggggctcaaccccgggactgctttggaaactgccatgctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgattactaggtgtcgggaagcaaagcttctcggtgccgcagccaacgcaataagtaatccacctggggagtacgttcgcaagaatgaaactcaaaggaattgacggggacccgcacaagcggtggagcatgtggtttaattcgaagcaacgcgaagaaccttacctggtcttgacatccccctggccggacagtaacgtgtcctttcctacgggacaggggagacaggtggtgcatggttgtcgtcagctcgtgtcgtgagatgttgggttaagtcccgcaacgagcgcaacccctatctttagtagccagcattccggatgggcactctagagagactgccagggacaacctggaggaaggtggggatgacgtcaaatcatcatgccccttatgatcagggctacacacgtgctacaatggcgtaaacaaagggaagcgaccctgcgaaggcaagcgaatcccaaaaataacgtcccagttcggattgtagtctgcaactcgactacatgaagctggaatcgctagtaatcgcgaatcagaatgtcgcggtgaatacgttcccgggtcttgtacacaccgcccgtcacaccatgggagtcggtaacgcccgaagtcagtgacccaaccgcaaggagggagctgccgaaggtgggaccgataactggggtgaagtcgtaacaaggtagccgtatcggaaggtgcggctggatcacctcctttctaaggaa

SEQ ID NO: 471 - DNA, 1527 bp, Clostridium sp. AF15-31
  ref <308>: DATABASE ACCESSION NUMBER: NCBI ACCESSION: NZ_QTXL01000004.1
  ref <309>: DATABASE ENTRY DATE: 2019-04-01
  ref <313>: RELEVANT RESIDUES IN SEQ ID NO: (1)..(1527)
tttaatgagagtttgatcctggctcaggatgaacgctggcggcgtgcttaacacatgcaagtcgaacgagagaagatcggtgcttgcactgatccgatcgagtggcggacgggtgagtaacgcgtgggtaacctgcctcatacaggggaataacagttggaaacggctgctaaaaccgcataagcgcacagtatcgcatgatacagtgtgaaaaactccggtggtatgagatggacccgcgtctgattagctagttggtgaggtaacggcccaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagccaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaaccggaactttccttcgggacagcagagacaggtggtgcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 472 - DNA, 1527 bp, Clostridium sp. AF15-41
  ref <308>: DATABASE ACCESSION NUMBER: NCBI ACCESSION: NZ_QTMQ01000014.1
  ref <309>: DATABASE ENTRY DATE: 2019-04-01
  ref <313>: RELEVANT RESIDUES IN SEQ ID NO: (1)..(1527)
tttaatgagagtttgatcctggctcaggatgaacgctggcggcgtgcttaacacatgcaagtcgaacgagagaagattggtgcttgcactgatccgatcgagtggcggacgggtgagtaacgcgtgggtaacctgcctcatacaggggaataacagttggaaacggctgctaaaaccgcataagcgcacagtatcgcatgatacagtgtgaaaaactccggtggtatgagatggacccgcgtctgattagctagttggtgaggtaacggcccaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagccaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaatcggaactttccttcgggacagcagagacaggtggtgcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 473 - DNA, 1530 bp, Clostridium sp. AF15-49
  ref <308>: DATABASE ACCESSION NUMBER: NCBI ACCESSION: NZ_QTXK01000003.1
  ref <309>: DATABASE ENTRY DATE: 2019-04-01
  ref <313>: RELEVANT RESIDUES IN SEQ ID NO: (1)..(1530)
tttttatgagagtttgatcctggctcaggatgaacgctggcggcgtgcttaacacatgcaagtcgaacgaagatgccggagtgcttgcactttggcagactgagtggcggacgggtgagtaacgcgtgggtaacctgccttatacagggggataacagttggaaacgactgctaataccgcataagcgcacggtatcgcatgatacagtgtgaaaaactccggtggtataagatggacccgcgtctgattagcttgttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaaactctatcagcagggaagataatgacggtacctgactaagaagcaccggctaaatacgtgccagcagccgcggtaatacgtatggtgcaagcgttatccggatttactgggtgtaaagggtgcgtaggtggtatggcaagtcagaagtgaaaggctggggctcaaccccgggactgcttttgaaactgtcaaactagagtacaggagaggaaagcggaattcctagtgtagcggtgaaatgcgtagatattaggaggaacaccagtggcgaaggcggctttctggactgaaactgacactgaggcacgaaagcgtggggagcaaacaggattagataccctggtagtccacgccgtaaacgatgaatactaggtgtcgggcagcatagctgttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggtcttgacatcccgatggccgcttcttaatcgaagcttttcttcggaacatcggagacaggtggtgcatggttgtcgtcagctcgtgtcgtgagatgttgggttaagtcccgcaacgagcgcaacccctattttcagtagccagcattttggatgggcactctggagagactgcccgggataaccgggaggaaggtggggatgacgtcaaatcatcatgccccttatgatctgggctacacacgtgctacaatggctgttacagagagaagcgaatccgcgaggaagagcaaacctcaaaaaggcagtctcagttcggattgtagtctgcaactcgactacatgaagctggaatcgctagtaatcgcgaatcagaatgtcgcggtgaatacgttcccgggtcttgtacacaccgcccgtcacaccatgggagttggaaatgcccgaagtcagtgacccaaccgcaaggagggagctgccgaaggcaggttcgatgactggggtgaagtcgtaacaaggtagccgtatcggaaggtgcggctggatcacctcctttctaaggaa

SEQ ID NO: 474 - DNA, 1530 bp, Clostridium sp. AF16-25; identical to SEQ ID NO: 473
  ref <308>: DATABASE ACCESSION NUMBER: NCBI ACCESSION: NZ_QTXG01000005.1
  ref <309>: DATABASE ENTRY DATE: 2019-04-01
  ref <313>: RELEVANT RESIDUES IN SEQ ID NO: (1)..(1530)

SEQ ID NO: 475 - DNA, 1447 bp, Clostridium sp. AF17-21AC
  ref <308>: DATABASE ACCESSION NUMBER: NCBI ACCESSION: NZ_QTWY01000014.1
  ref <309>: DATABASE ENTRY DATE: 2019-04-01
  ref <313>: RELEVANT RESIDUES IN SEQ ID NO: (1)..(1447)
tgcttgcactgatccgatcgagtggcggacgggtgagtaacgcgtgggtaacctgcctcatacaggggaataacagttggaaacggctgctaaaaccgcataagcgcacagtatcgcatgatacggtgtgaaaaactccggtggtatgagatggacccgcgtctgattagctagttggtgaggtaacggcccaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagccaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaaccggaattttccttcgggacagcagagacaggtggtgcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 476 - DNA, 1438 bp, Clostridium sp. AF18-27
  ref <308>: DATABASE ACCESSION NUMBER: NCBI ACCESSION: NZ_QUGT01000047.1
  ref <309>: DATABASE ENTRY DATE: 2019-04-01
  ref <313>: RELEVANT RESIDUES IN SEQ ID NO: (1)..(1438)
tttaatttgagagtttgatcctggctcaggatgaacgctggcggcgtgcctaacacatgcaagtcgaacgaagcattttgaatgaagttttcggatggattttaagatgactgagtggcggacgggtgagtaacacgtggataacctgcctcacactgggggacaacagttagaaatgactgctaataccgcataagcgcacagtaccgcatggtacagtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatccccctgaccggcgtgtaacggcgcctttccttcgggacaggggagacaggtggtgcatggttgtcgtcagctcgtgtcgtgagatgttgggttaagtcccgcaacgagcgcaacccttatccttagtagccagcagtgagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaac

SEQ ID NO: 477 - DNA, 1460 bp, Clostridium sp. AF19-22AC
  ref <308>: DATABASE ACCESSION NUMBER: NCBI ACCESSION: NZ_QUGN01000060.1
  ref <309>: DATABASE ENTRY DATE: 2019-04-01
  ref <313>: RELEVANT RESIDUES IN SEQ ID NO: (1)..(1460)
tgatttcttcggaatgaagagtgttgtgactgagcggcggacgggtgagtaacgcgtgggtaacctgcctcatacagggggataacagttagaaatgactgctaataccgtataagaccacagtgccgcatggcacagtggtaaaaactccggtggtatgagatggacccgcgtctgattagctagttggtagggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggtgatgcaagtctgatgtgaaaacccggggctcaaccccgggactgcattggaaactgtgtgactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgaatactaggtgtcgggtggcaaagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctgctcttgacatcccgctgaccggccagtaatgtggccttcccttcggggcagtggagacaggtggtgcatggttgtcgtcagctcgtgtcgtgagatgttgggttaagtcccgcaacgagcgcaacccttatctttagtagccagcggtcaggccgggcactctagagagactgccagggataacctggaggaaggtggggatgacgtcaaatcatcatgccccttatgagcagggctacacacgtgctacaatggcgtaaacaaagggaggcaatactgtgaagtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgaaggtgggaccgataactggggtgaagtcgtaacaaggtagccgtatcggaaggtgcggctggatcacctcctttctaaggaa

SEQ ID NO: 478 - DNA, 1511 bp, Clostridium sp. AF20-17LB
  ref <308>: DATABASE ACCESSION NUMBER: NCBI ACCESSION: NZ_QUGG01000015.1
  ref <309>: DATABASE ENTRY DATE: 2019-04-01
  ref <313>: RELEVANT RESIDUES IN SEQ ID NO: (1)..(1511)
tttaacatgagagtttgatcctggctcaggatgaacgctggcggcgtgcctaacacatgcaagtcgaacgaggtaaatgagatgaagttttcggatggattcttatttaccgagtggcggacgggtgagtaacgcgtgggtaacctgcctcatacagggggataacgattggaaacgattgctaataccgcataagcgcacagtaccacatggtacagtgtgaaaaactccggtggtatgagatggacccgcgtctgattagctagttggtgaggtaacggcccaccaaggcaacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaatacccgggctcaacctgggaactgctttggaaactgtatggctagagtgctggagaggtaagcggaattcctagtgtagcggtgaaatgcgtagatattaggaagaacaccagtggcgaaggcggcttactggacagtaactgacgttcaggctcgaaagcgtggggagcaaacaggattagataccctggtagtccacgccgtaaacgatgaatactaggtgtcgggggacaaagtctttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaaagcctttaatcgggctcctccttcgggacagaggtgacaggtggtgcatggttgtcgtcagctcgtgtcgtgagatgttgggttaagtcccgcaacgagcgcaacccctattgtcagtagccagcagttcggctgggcactctgatgagactgccagggataacctggaggaaggtggggatgacgtcaaatcatcatgccccttatgatttgggctacacacgtgctacaatggcgtaaacaaagagaagcgaagctgtgaggcagagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaagg

SEQ ID NO: 479 - DNA, 1541 bp, Clostridium sp. AF20-7
  ref <308>: DATABASE ACCESSION NUMBER: NCBI ACCESSION: NZ_QUGF01000001.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcaatctaacggaagttttcggatggaagctagattgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctggttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaggcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgaaaggagggagctgccgaaggcaggaccgataactggggtgaagtcgtaacaaggtagccgtatcggaaggtgcggctggatcacctcctttctaaggaa

SEQ ID NO: 480 - DNA, 1249 bp, Clostridium sp. AF21-20LB
  ref <308>: DATABASE ACCESSION NUMBER: NCBI ACCESSION: NZ_QUGD01000058.1
  ref <309>: DATABASE ENTRY DATE: 2019-04-01
  ref <313>: RELEVANT RESIDUES IN SEQ ID NO: (1)..(1249)
gggggacaacagttagaaatgactgctaataccgcataagcgcacaggaccgcatggtccggtgtgaaaaactccggtggtgtgagatggacccgcgtttgattagctagttggtggggtaacggcctaccaagcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgg

SEQ ID NO: 481 - DNA, 1440 bp, Clostridium sp. AF22-10
  ref <308>: DATABASE ACCESSION NUMBER: NCBI ACCESSION: NZ_QUFZ01000069.1
  ref <309>: DATABASE ENTRY DATE: 2019-04-01
  ref <313>: RELEVANT RESIDUES IN SEQ ID NO: (1)..(1440)
tttaacatgagagtttgatcctggctcaggatgaacgctggcggcgtgcttaacacatgcaagtcgaacgaagcaatctaacggaagttttcggatggaagctagattgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctagttggtggggtaacggcctaccaagcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccg

SEQ ID NO: 482 - DNA, 1527 bp, Clostridium sp. AF23-6LB
  ref <308>: DATABASE ACCESSION NUMBER: NCBI ACCESSION: NZ_QTWK01000004.1
  ref <309>: DATABASE ENTRY DATE: 2019-04-01
  ref <313>: RELEVANT RESIDUES IN SEQ ID NO: (1)..(1527)
tttaatgagagtttgatcctggctcaggatgaacgctggcggcgtgcttaacacatgcaagtcgaacgagagaagattggtgcttgcactgatccgatcgagtggcggacgggtgagtaacgcgtgggtaacctgcctcatacaggggaataacagttggaaacggctgctaaaaccgcataagcgcacagtatcgcatgatacagtgtgaaaaactccggtggtatgagatggacccgcgtctgattagctagttggtgaggtaacggcccaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagccaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaaccggaattttccttcgggacagcagagacaggtggtgcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgcaaggagggagttgccgaaggcaggttcgataactggggtgaagtcgtaacaaggtagccgtatcggaaggtgcggctggatcacctcctttctaaggaa

SEQ ID NO: 483 - DNA, 1530 bp, Clostridium sp. AF23-8
  ref <308>: DATABASE ACCESSION NUMBER: NCBI ACCESSION: NZ_QUFV01000003.1
  ref <309>: DATABASE ENTRY DATE: 2019-04-01
  ref <313>: RELEVANT RESIDUES IN SEQ ID NO: (1)..(1530)
tttttatgagagtttgatcctggctcaggatgaacgctggcggcgtgcttaacacatgcaagtcgaacgaagatgccggagtgcttgcactttggcagactgagtggcggacgggtgagtaacgcgtgggtaacctgccttatacagggggataacagttggaaacgactgctaataccgcataagcgcacggtatcgcatgatacagtgtgaaaaactccggtggtataagatggacccgcgtctgattagcttgttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaaactctatcagcagggaagataatgacggtacctgactaagaagcaccggctaaatacgtgccagcagccgcggtaatacgtatggtgcaagcgttatccggatttactgggtgtaaagggtgcgtaggtggtatggcaagtcagaagtgaaaggctggggctcaaccccgggactgcttttgaaactgtcaaactagagtacaggagaggaaagcggaattcctagtgtagcggtgaaatgcgtagatattaggaggaacaccagtggcgaaggcggctttctggactgaaactgacactgaggcacgaaagcgtggggagcaaacaggattagataccctggtagtccacgccgtaaacgatgaatactaggtgtcgggcagcatagctgttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggtcttgacatcccgatgaccgcttcttaatcgaagcttttcttcggaacatcggagacaggtggtgcatggttgtcgtcagctcgtgtcgtgagatgttgggttaagtcccgcaacgagcgcaacccctattttcagtagccagcattttggatgggcactctggagagactgcccgggataaccgggaggaaggtggggatgacgtcaaatcatcatgccccttatgatctgggctacacacgtgctacaatggctgttacagagagaagcgaatccgcgaggaagagcaaacctcaaaaaggcagtctcagttcggattgtagtctgcaactcgactacatgaagctggaatcgctagtaatcgcgaatcagaatgtcgcggtgaatacgttcccgggtcttgtacacaccgcccgtcacaccatgggagttggaaatgcccgaagtcagtgacccaaccgcaaggagggagctgccgaaggcaggttcgatgactggggtgaagtcgtaacaaggtagccgtatcggaaggtgcggctggatcacctcctttctaaggaa

SEQ ID NO: 484 - DNA, 1439 bp, Clostridium sp. AF27-2AA
  ref <308>: DATABASE ACCESSION NUMBER: NCBI ACCESSION: NZ_QUFI01000075.1
  ref <309>: DATABASE ENTRY DATE: 2019-04-01
  ref <313>: RELEVANT RESIDUES IN SEQ ID NO: (1)..(1439)
ttcatttgtgactgagcggcggacgggtgagtaacgcgtgggtaacctgcctcatacagggggataacagttggaaacgactgctaataccgcataagcgcacagtaccgcatggtacagtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgagacaagtctgaagtgaaagcccggggctcaaccccgggactgctttggaaactgccttgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatccctttgaaaagcccgtaacggggctccctcttcggagcaaaggtgacaggtggtgcatggttgtcgtcagctcgtgtcgtgagatgttgggttaagtcccgcaacgagcgcaacccttatcctcagtagccagcagtaagatgggcactctgtggagactgccagggataacctggaggaaggtggggatgacgtcaaatcatcatgccccttatgatttgggctacacacgtgctacaatggcgtaaacaaagagaagcgagcctgcgagggggagcaaatctcaaaaataacgtctcagttcggattgcaggctgcaactcgcctgcatgaagctggaatcgctagtaatcgcggatcagaatgccgcggtgaatacgttcccgggtcttgtacacaccgcccgtcacaccatgggagtcgataacgcccgaagtcagtgacccaaccgcaaggagggagctgccgaaggcgggattgataactggggtgaagtcgtaacaaggtagccgtatcggaaggtgcggctggatcacctcctttctaagg

SEQ ID NO: 485 - DNA, 1541 bp, Clostridium sp. AF27-5AA
  ref <308>: DATABASE ACCESSION NUMBER: NCBI ACCESSION: NZ_QUFH01000011.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcgatttgacggaagttttcggatggaagttaaattgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgtaaggagggagctgccgaaggcaggaccgataactggggtgaagtcgtaacaaggtagccgtatcggaaggtgcggctggatcacctcctttctaaggaa

SEQ ID NO: 486 - DNA, 1335 bp, Clostridium sp. AF29-8BH
  ref <308>: DATABASE ACCESSION NUMBER: NCBI ACCESSION: NZ_QUEL01000058.1
  ref <309>: DATABASE ENTRY DATE: 2019-04-01
  ref <313>: RELEVANT RESIDUES IN SEQ ID NO: (1)..(1335)
attgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctagttggtggggtaacggcctaccaagcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaggcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccg

SEQ ID NO: 487 - DNA, 1301 bp, Clostridium sp. AF32-12BH
  ref <308>: DATABASE ACCESSION NUMBER: NCBI ACCESSION: NZ_QUEH01000047.1
  ref <309>: DATABASE ENTRY DATE: 2019-04-01
  ref <313>: RELEVANT RESIDUES IN SEQ ID NO: (1)..(1301)
atgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgagacaagtctgaagtgaaagcccggggctcaaccccgggactgctttggaaactgccttgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatcccgatgaaaagtccttaaccggactccctcttcggagcatcggtgacaggtggtgcatggttgtcgtcagctcgtgtcgtgagatgttgggttaagtcccgcaacgagcgcaacccttatcctcagtagccagcagtaagatgggcactctggggagactgccagggataacctggaggaaggtggggatgacgtcaaatcatcatgccccttatgatttgggctacacacgtgctacaatggcgtaaacaaagagaagcgagcccgcgagggggagcaaatctcaaaaataacgtctcagttcggattgcaggctgcaactcgcctgcatgaagctggaatcgctagtaatcgcggatcagaatgccgcggtgaatacgttcccgggtcttgtacacaccgcccgtcacaccatgggagtcgataacgcccgaagtcagtgacccaaccgcaaggagggagctgccgaaggcgggattgataactggggtgaagtcgtaacaaggtagccgtatcggaaggtgcggctggatcacctcctttctaagga

SEQ ID NO: 488 - DNA, 1541 bp, Clostridium sp. AF32-7AC
  ref <308>: DATABASE ACCESSION NUMBER: NCBI ACCESSION: NZ_QUEG01000010.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcaatttagcggaagttttcggatggaagctggattgactgagtggcggacgggtgagtaacgcgtgggtaacctgcctcacactgggggacaacagttagaaatgactgctaataccgcataagcgcacgggaccgcatggtccagtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaggcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgtaaggagggagctgccgaaggcaggaccgataactggggtgaagtcgtaacaaggtagccgtatcggaaggtgcggctggatcacctcctttctaaggaa

SEQ ID NO: 489 - DNA, 1541 bp, Clostridium sp. AF34-13
  ref <308>: DATABASE ACCESSION NUMBER: NCBI ACCESSION: NZ_QUEB01000030.1
  ref <309>: DATABASE ENTRY DATE: 2019-04-01
  ref <313>: RELEVANT RESIDUES IN SEQ ID NO: (1)..(1541)
ttaaacatgagagtttgatcctggctcaggatgaacgctggcggcgtgcctaacacatgcaagtcgaacgaagctcctgcgacagattccttcgggatgaagatgcttgagacttagtggcggacgggtgagtaacgcgtgggtaacctgccctgtactgggggacaacagttagaaatgactgctaataccgcataagcctacagagtcgcatgactcagcaggaaaaattccggtggtacaggatgggcccgcgtctgattagctagttggtgaggtaatggctcaccaaggcgacgatcagtagccggcttgagagagtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgcaggcggtctggcaagtctgatgtgaaaatccggggctcaactccggaactgcattggaaactgtcagactagagtgtcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggcacaaaagtgcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccagtccttgacatcccgatgaccgacctgtaacgaggtcttctcttcggagcatcggagacaggtggtgcatggttgtcgtcagctcgtgtcgtgagatgttgggttaagtcccgcaacgagcgcaacccctgtccttagtagccagcagttcggctgggcactctagggagactgccggggataacccggaggaaggtggggacgacgtcaaatcatcatgccccttatgggctgggctacacacgtgctacaatggtgctaacaaagtgaagcaagctggtgacagtaagcaaatcacaaaaatggcatctcagttcggattgtagtctgcaactcgactacatgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggtctgataactggggtgaagtcgtaacaaggtagccgtatcggaaggtgcggctggatcacctcctttctaag

SEQ ID NO: 490 - DNA, 1557 bp, Clostridium sp. AF36-4
  ref <308>: DATABASE ACCESSION NUMBER: NCBI ACCESSION: NZ_QTVH01000004.1
  ref <309>: DATABASE ENTRY DATE: 2019-04-01
  ref <313>: RELEVANT RESIDUES IN SEQ ID NO: (1)..(1557)
tttaacatgagagtttgatcctggctcaggatgaacgctggcggcgtgcttaacacatgcaagtcgaacgaagcacctctcccgaagattgacacagcttgctgtagattgattcatttgaggtgactgagtggcggacgggtgagtaacgcgtgggtaacctgcctcatagagggggacaacagttggaaacgactgctaataccgcatagtaagaaagattcgcatgtttctttcttgaaagatttatcgctatgagatggacccgcgtctgattagctagttggtaaggtaacggcttaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggtgcgtaggtggcaaggcaagtcagatgtgaaagcccggggctcaaccccggtactgcatttgaaactgtctagctagagtgcaggagaggtaagcggaattcctagtgtagcggtgaaatgcgtagatattaggaggaacaccagtggcgaaggcggcttactggactgtaactgacactgaggcacgaaagcgtggggagcaaacaggattagataccctggtagtccacgccgtaaacgatgaatactaggtgtcggggcccacagggcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccttctgaccgttccttagccggaacttcccttcggggcagaagtgacaggtggtgcatggttgtcgtcagctcgtgtcgtgagatgttgggttaagtcccgcaacgagcgcaacccttatccttagtagccagcggttcggccgggcactctggggagactgccggagataatccggaggaaggtggggatgacgtcaaatcatcatgccccttatgacttgggctacacacgtgctacaatggcggtaacaaagggaagcagcctcgcgagagtgagcaaaccccaaaaatgccgtctcagttcggattgtagtctgcaactcgactacatgaagctggaatcgctagtaatcgcagatcagaatgctgcggtgaatacgttcccgggtcttgtacacaccgcccgtcacaccatgggagtcggatatgcccgaagccagtgacccaaccgcaaggagggagctgtcgaaggtggagccgataactggggtgaagtcgtaacaaggtagccgtatcggaaggtgcggctggatcacctcctttctaaggaa

SEQ ID NO: 491 - DNA, 1557 bp, Clostridium sp. AF37-5
  ref <308>: DATABASE ACCESSION NUMBER: NCBI ACCESSION: NZ_QUDR01000049.1
  ref <309>: DATABASE ENTRY DATE: 2019-04-01
  ref <313>: RELEVANT RESIDUES IN SEQ ID NO: (1)..(1557)
tttaacatgagagtttgatcctggctcaggatgaacgctggcggcgtgcttaacacatgcaagtcgaacgaagcacctctcccgaagattgacacagcttgctgtagattgattcatttgaggtgactgagtggcggacgggtgagtaacgcgtgggtaacctgcctcatagagggggacaacagttggaaacgactgctaataccgcatagtaagaaagattcgcatgtttctttcttgaaagatttatcgctatgagatggacccgcgtctgattagctagttggtaaggtaacggcttaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggtgcgtaggtggcaaggcaagtcagatgtgaaagcccggggctcaaccccggtactgcatttgaaactgtctagctagagtgcaggagaggtaagcggaattcctagtgtagcggtgaaatgcgtagatattaggaggaacaccagtggcgaaggcggcttactggactgtaactgacactgaggcacgaaagcgtggggagcaaacaggattagataccctggtagtccacgccgtaaacgatgaatactaggtgtcggggcccacagggcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccttctgaccgttccttagccggaacttctcttcggagcagaagtgacaggtggtgcatggttgtcgtcagctcgtgtcgtgagatgttgggttaagtcccgcaacgagcgcaacccttatccttagtagccagcggttcggccgggcactctggggagactgccggagataatccggaggaaggtggggatgacgtcaaatcatcatgccccttatgacttgggctacacacgtgctacaatggcggtaacaaagggaagcagcctcgcgagagtgagcaaaccccaaaaatgccgtctcagttcggattgtagtctgcaactcgactacatgaagctggaatcgctagtaatcgcagatcagaatgctgcggtgaatacgttcccgggtcttgtacacaccgcccgtcacaccatgggagtcggatatgcccgaagccagtgacccaaccgcaaggagggagctgtcgaaggtggagccgataactggggtgaagtcgtaacaaggtagccgtatcggaaggtgcggctggatcacctcctttctaaggaa

SEQ ID NO: 492 - DNA, 1540 bp, Clostridium sp. AF37-5AT
  ref <308>: DATABASE ACCESSION NUMBER: NCBI ACCESSION: NZ_QUDQ01000032.1
  ref <309>: DATABASE ENTRY DATE: 2019-04-01
  ref <313>: RELEVANT RESIDUES IN SEQ ID NO: (1)..(1540)
tttaacatgagagtttgagcctggctcaggatgaacgctggcggcgtgcctaacacatgcaagtcgaacgaggcgttttgaatgaagttttcggatggattttaaaacaccgagtggcggacgggtgagtaacgcgtgggtaacctgcctcatacagggggataacgattggaaacgattgctaataccgcataagcgcacagtaccacatggtacggtgtgaaaaactccggtggtatgagatggacccgcgtctgattagctagttggtgaggtaacggcccaccaaggcaacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaatacccgggctcaacctgggaactgctttggaaactgtatggctagagtgctggagaggtaagcggaattcctagtgtagcggtgaaatgcgtagatattaggaagaacaccagtggcgaaggcggcttactggacagtaactgacgttcaggctcgaaagcgtggggagcaaacaggattagataccctggtagtccacgccgtaaacgatgaatactaggtgtcgggggacaaagtctttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaacactcttaatcgagtgcctccttcgggacagaggtgacaggtggtgcatggttgtcgtcagctcgtgtcgtgagatgttgggttaagtcccgcaacgagcgcaacccctattgtcagtagccagcagttcggctgggcactctgatgagactgccagggataacctggaggaaggtggggatgacgtcaaatcatcatgccccttatgatttgggctacacacgtgctacaatggcgtaaacaaagagaagcaaagctgtgaggcagagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctcctttctaaggaa

SEQ ID NO: 493 - DNA, 1406 bp, Clostridium sp. AF37-7
  ref <308>: DATABASE ACCESSION NUMBER: NCBI ACCESSION: NZ_QUDP01000057.1
  ref <309>: DATABASE ENTRY DATE: 2019-04-01
  ref <313>: RELEVANT RESIDUES IN SEQ ID NO: (1)..(1406)
tttaacatgagagtttgatcctggctcaggatgaacgctggcggcgtgcttaacacatgcaagtcgaacgaagcaatctaacggaagttttcggatggaagttagattgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctagttggtggggtaacggcctaccaagcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgg

SEQ ID NO: 494 - DNA, 1529 bp, Clostridium sp. AF43-10
  ref <308>: DATABASE ACCESSION NUMBER: NCBI ACCESSION: NZ_QUDL01000030.1
  ref <309>: DATABASE ENTRY DATE: 2019-04-01
  ref <313>: RELEVANT RESIDUES IN SEQ ID NO: (1)..(1529)
tttttatgagagtttgatcctggctcaggatgaacgctggcggcgtgcttaacacatgcaagtcgaacgaagatgccggagtgcttgcactttggcagactgagtggcggacgggtgagtaacgcgtgggtaacctgccttatacagggggataacagttggaaacgactgctaataccgcataagcgcacggtatcgcatgatacagtgtgaaaaactccggtggtataagatggacccgcgtctgattagcttgttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaaactctatcagcagggaagataatgacggtacctgactaagaagcaccggctaaatacgtgccagcagccgcggtaatacgtatggtgcaagcgttatccggatttactgggtgtaaagggtgcgtaggtggtatggcaagtcagaagtgaaaggctggggctcaaccccgggactgcttttgaaactgtcaaactagagtacaggagaggaaagcggaattcctagtgtagcggtgaaatgcgtagatattaggaggaacaccagtggcgaaggcggctttctggactgaaactgacactgaggcacgaaagcgtggggagcaaacaggattagataccctggtagtccacgccgtaaacgatgaatactaggtgtcgggcagcatagctgttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggtcttgacatcccgatggccgcttcttaatcgaagcttttcttcggaacatcggagacaggtggtgcatggttgtcgtcagctcgtgtcgtgagatgttgggttaagtcccgcaacgagcgcaacccctattttcagtagccagcatttggatgggcactctggagagactgcccgggataaccgggaggaaggtggggatgacgtcaaatcatcatgccccttatgatctgggctacacacgtgctacaatggctgttacagagagaagcgaatccgcgaggaagagcaaacctcaaaaaggcagtctcagttcggattgtagtctgcaactcgactacatgaagctggaatcgctagtaatcgcgaatcagaatgtcgcggtgaatacgttcccgggtcttgtacacaccgcccgtcacaccatgggagttggaaatgcccgaagtcagtgacccaaccgcaaggagggagctgccgaaggcaggttcgatgactggggtgaagtcgtaacaaggtagccgtatcggaaggtgcggctggatcacctcctttctaaggaa

SEQ ID NO: 495 - DNA, 1528 bp, Clostridium sp. AF46-12NS
  ref <308>: DATABASE ACCESSION NUMBER: NCBI ACCESSION: NZ_QTUZ01000004.1
  ref <309>: DATABASE ENTRY DATE: 2019-04-01
  ref <313>: RELEVANT RESIDUES IN SEQ ID NO: (1)..(1528)
tttaacatgagagtttgatcctggctcaggatgaacgctggcggcgtgcctaacacatgcaagtcgaacggacttttcatgaagcctagcgattgaaaagttagtggcggacgggtgagtaacgcgtgggtaacctgccttgtactgggggacaacagttggaaacgactgctaataccgcataagcgcacagcttcgcatgaagcagtgtgaaaaactccggtggtacaagatggacccgcgtctgattagctggttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcaggaaagaaaatgacggtacctgactaagaagccccggctaactacgtgccagcagccgcggtaatacgtagggggcaagcgttatccggatttactgggtgtaaagggagcgtagacggttttgcaagtctgaagtgaaagcccggggcttaaccccgggactgctttggaaactgtagaactagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgattactaggtgttggtgggtacgacccatcggtgccgcagcaaacgcaataagtaatccacctggggagtacgttcgcaagaatgaaactcaaaggaattgacggggacccgcacaagcggtggagcatgtggtttaattcgaagcaacgcgaagaaccttacctggtcttgacatccctatgaataacgggcaatgccgttagtacttcggtacataggagacaggtggtgcatggttgtcgtcagctcgtgtcgtgagatgttgggttaagtcccgcaacgagcgcaacccttatctttagtagccagcagtaagatgggcactctagagagactgccggggataacccggaggaaggtggggatgacgtcaaatcatcatgccccttatgaccagggctacacacgtgctacaatggcgtaaacaaagagaagcgaagtcgtgaggcagagcgaatctcaaaaataacgtctcagttcggattgtagtctgcaactcgactacatgaagctggaatcgctagtaatcgcagacagaatgctgcggtgaatacgttcccgggtcttgtacacaccgcccgtcacaccatgggagtcggaaatgcccgaagtcggtgacctaaccgcaaggaaggagccgccgaaggcaggtctgataactggggtgaagtcgtaacaaggtagccgtatcggaaggtgcggctggatcacctcctttctaaggaa

SEQ ID NO: 496 - DNA, 1528 bp, Clostridium sp. AF46-9NS
  ref <308>: DATABASE ACCESSION NUMBER: NCBI ACCESSION: NZ_QTUY01000054.1
  ref <309>: DATABASE ENTRY DATE: 2019-04-01
  ref <313>: RELEVANT RESIDUES IN SEQ ID NO: (1)..(1528)
tttaacatgagagtttgatcctggctcaggatgaacgctggcggcgtgcctaacacatgcaagtcgaacggacttacattgaagcctagcgatatgtaagttagtggcggacgggtgagtaacgcgtgggtaacctgccttgtactgggggacaacagttggaaacgactgctaataccgcataagcgcacagcttcgcatgaagcagtgtgaaaaactccggtggtacaagatggacccgcgtctgattagctggttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcaggaaagaaaatgacggtacctgactaagaagccccggctaactacgtgccagcagccgcggtaatacgtagggggcaagcgttatccggatttactgggtgtaaagggagcgtagacggttttgcaagtctgaagtgaaagcccggggcttaaccccgggactgctttggaaactgtagaactagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgattactaggtgttggtgggtacgacccatcggtgccgcagcaaacgcaataagtaatccacctggggagtacgttcgcaagaatgaaactcaaaggaattgacggggacccgcacaagcggtggagcatgtggtttaattcgaagcaacgcgaagaaccttacctggtcttgacatccctatgaataacgggcaatgccgttagtacttcggtacataggagacaggtggtgcatggttgtcgtcagctcgtgtcgtgagatgttgggttaagtcccgcaacgagcgcaacccttatctttagtagccagcagtaagatgggcactctagagagactgccggggataacccggaggaaggtggggatgacgtcaaatcatcatgccccttatgaccagggctacacacgtgctacaatggcgtaaacaaagagaagcgaagtcgtgaggcagagcgaatctcaaaaataacgtctcagttcggattgtagtctgcaactcgactacatgaagctggaatcgctagtaatcgcagacagaatgctgcggtgaatacgttcccgggtcttgtacacaccgcccgtcacaccatgggagtcggaaatgcccgaagtcggtgacctaaccgcaaggaaggagccgccgaaggcaggtctgataactggggtgaagtcgtaacaaggtagccgtatcggaaggtgcggctggatcacctcctttctaaggaa

SEQ ID NO: 497 - DNA, 1335 bp, Clostridium sp. AF50-3; identical to SEQ ID NO: 486
  ref <308>: DATABASE ACCESSION NUMBER: NCBI ACCESSION: NZ_QUDH01000034.1
  ref <309>: DATABASE ENTRY DATE: 2019-04-01
  ref <313>: RELEVANT RESIDUES IN SEQ ID NO: (1)..(1335)

SEQ ID NO: 498 - DNA, 1519 bp, Clostridium sp. AM09-51
  ref <308>: DATABASE ACCESSION NUMBER: NCBI ACCESSION: NZ_QUDC01000017.1
  ref <309>: DATABASE ENTRY DATE: 2019-04-01
  ref <313>: RELEVANT RESIDUES IN SEQ ID NO: (1)..(1519)
tttttgagagtttgatcctggctcaggacgaacgctggcggcgtgcctaacacatgcaagtcgaacgaagctttgaggagcttgctttttaaagcttagtggcggacgggtgagtaacgcgtgagcaacctgcctctcagagggggataacgttttgaaaagaacgctaataccgcataacatatcggaaccgcatgattctgatatcaaaggagcaatccgctgagagatgggctcgcgtccgattagttagttggtgaggtaacggctcaccaagactacgatcggtagccggactgagaggttgatcggccacattgggactgagacacggcccagactcctacgggaggcagcagtgggggatattgcgcaatgggggaaaccctgacgcagcaacgccgcgtgaaggaagaaggtcttcggattgtaaacttcttttgtcagggacgaagaaagtgacggtacctgacgaataagctccggctaactacgtgccagcagccgcggtaatacgtagggagcgagcgttgtccggatttactgggtgtaaagggtgcgtaggcggccgagcaagtcagttgtgaaaactatgggcttaacccataacgtgcaattgaaactgtccggcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcctgagaatccttaagagattagggagtgccttcgggaactcagagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggccatcaacagagggaagcaaaaccgcgaggcagagcaaacccctaaaaatggtcccagttcggattgtaggctgcaacccgcctacatgaagttggaattgctagtaatcgcggatcagcatgccgcggtgaatacgttcccgggccttgtacacaccgcccgtcacaccatgggagccggtaatacccgaagtcagtagtctaacagcaatgaggacgctgccgaaggtaggattggcgactggggtgaagtcgtaacaaggtagccgtatcggaaggtgcggctggatcacctcctttcta

SEQ ID NO: 499 - DNA, 1540 bp, Clostridium sp. AM16-23
  ref <308>: DATABASE ACCESSION NUMBER: NCBI ACCESSION: NZ_QUCX01000004.1
  ref <309>: DATABASE ENTRY DATE: 2019-04-01
  ref <313>: RELEVANT RESIDUES IN SEQ ID NO: (1)..(1540)
tttaacatgagagtttgatcctggctcaggatgaacgctggcggcgtgcctaacacatgcaagtcgaacgaggtaaatgagatgaagttttcggatggattcttatttaccgagtggcggacgggtgagtaacgcgtgggtaacctgcctcatacagggggataacgattggaaacgattgctaataccgcataagcgcacagtaccacatggtacggtgtgaaaaactccggtggtatgagatggacccgcgtctgattagctagttggtgaggtaacggcccaccaaggcaacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaatacccgggctcaacctgggaactgctttggaaactgtatggctagagtgctggagaggtaagcggaattcctagtgtagcggtgaaatgcgtagatattaggaagaacaccagtggcgaaggcggcttactggacagtaactgacgttcaggctcgaaagcgtggggagcaaacaggattagataccctggtagtccacgccgtaaacgatgaatactaggtgtcgggggacaaagtctttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaacactcttaatcgagtgcctccttcgggacagaggtgacaggtggtgcatggttgtcgtcagctcgtgtcgtgagatgttgggttaagtcccgcaacgagcgcaacccctattgtcagtagccagcagttcggctgggcactctgatgagactgccagggataacctggaggaaggtggggatgacgtcaaatcatcatgccccttatgatttgggctacacacgtgctacaatggcgtaaacaaagagaagcgaagctgcgaggcagagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctcctttctaaggaa

SEQ ID NO: 500 - DNA, 1541 bp, Clostridium sp. AM18-55
  ref <308>: DATABASE ACCESSION NUMBER: NCBI ACCESSION: NZ_QUCO01000056.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcaatctaacggaagttttcggatggaagttggattgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcggtttggccgggcactcttgggagactgccagggataacctggaggaaggtggggatgacgtcaaatcatcatgccccttatgatttgggctacacacgtgctacaatggcgtaaacaaagagaggcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgcaaggagggagctgccgaaggcaggaccgataactggggtgaagtcgtaacaaggtagccgtatcggaaggtgcggctggatcacctcctttctaaggaa

SEQ ID NO: 501 - DNA, 1510 bp, Clostridium sp. AM22-11AC
  ref <308>: DATABASE ACCESSION NUMBER: NCBI ACCESSION: NZ_QUCM01000012.1
  ref <309>: DATABASE ENTRY DATE: 2019-04-01
  ref <313>: RELEVANT RESIDUES IN SEQ ID NO: (1)..(1510)
ggatgaacgctggcggcgtgcttaacacatgcaagtcgagcgaagcgatttaaatgagacttcggtggattttaaattgactgagcggcggacgggtgagtaacgcgtggataacctgcctcacacagggggataacagttagaaatgactgctaataccgcataagcgcacggtaccgcatggtacagtgtgaaaaactccggtggtgtgagatggatccgcgtctgattaggtagttggtgaggtaacggcccaccaagccgacgatcagtagccgacctgagagggtgaccggccacattgggactgagacacggcccaaactcctacgggaggcagcagtggggaatattgcacaatgggcgaaagcctgatgcagcaacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcactgcaagtctgaagtgaaagcccggggctcaaccccgggactgctttggaaactgtagagctagagtgctggagaggcaagcggaattcctagtgtagcggtgaaatgcgtagatattaggaagaacaccagtggcgaaggcggcttgctggacagtaactgacgttcaggctcgaaagcgtggggagcaaacaggattagataccctggtagtccacgccgtaaacgatgaatactaggtgttggtgggcaaagcccatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgtgatgaccggaacttaaccgttccttcccttcggggcatcatagacaggtggtgcatggttgtcgtcagctcgtgtcgtgagatgttgggttaagtcccgcaacgagcgcaacccttatcctcagtagccagcagtaagatgggcactctggggagactgccagggataacctggaggaaggtggggatgacgtcaaatcatcatgccccttatgatttgggctacacacgtgctacaatggcgtaaacaaagggaagcgatagggtgacctggagcaaatcccaaaaataacgtcccagttcggactgtagtctgcaacccgactacacgaagctggaatcgctagtaatcgcagatcagaatgctgcggtgaatacgttcccgggtcttgtacacaccgcccgtcacaccatgggagtcagcaacgcccgaagtcagtgactcaaccgcaaggagagagctgccgaaggcggggcaggtaactggggtgaagtcgtaacaaggtagccgtatcggaaggtgcggctggatcacctcctttctaaggaa

SEQ ID NO: 502 - DNA, 1432 bp, Clostridium sp. AM22-16AC
  ref <308>: DATABASE ACCESSION NUMBER: NCBI ACCESSION: NZ_QUCL01000007.1
  ref <309>: DATABASE ENTRY DATE: 2019-04-01
  ref <313>: RELEVANT RESIDUES IN SEQ ID NO: (1)..(1432)
accgagtggcggacgggtgagtaacgcgtgggtaacctgcctcatacagggggataacgattggaaacgattgctaataccgcataagcgcacagtaccacatggtacggtgtgaaaaactccggtggtatgagatggacccgcgtctgattagctagttggtgaggtaacggcccaccaaggcaacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaatacccgggctcaacctgggaactgctttggaaactgtatggctagagtgctggagaggtaagcggaattcctagtgtagcggtgaaatgcgtagatattaggaagaacaccagtggcgaaggcggcttactggacagtaactgacgttcaggctcgaaagcgtggggagcaaacaggattagataccctggtagtccacgccgtaaacgatgaatactaggtgtcgggggacaaagtctttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaacactcttaatcgagtgcctccttcgggacagaggtgacaggtggtgcatggttgtcgtcagctcgtgtcgtgagatgttgggttaagtcccgcaacgagcgcaacccctattgtcagtagccagcagttcggctgggcactctgatgagactgccagggataacctggaggaaggtggggatgacgtcaaatcatcatgccccttatgatttgggctacacacgtgctacaatggcgtaaacaaagagaagcgaagctgtgaggcagagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctcctttctaaggaa

SEQ ID NO: 503 - DNA, 1541 bp, Clostridium sp. AM27-28
  ref <308>: DATABASE ACCESSION NUMBER: NCBI ACCESSION: NZ_QUJT01000001.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcaatttaacggaagttttcggatggaagctagattgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgaaaggagggagctgccgaaggcaggaccgataactggggtgaagtcgtaacaaggtagccgtatcggaaggtgcggctggatcacctcctttctaaggaa

SEQ ID NO: 504 - DNA, 1541 bp, Clostridium sp. AM27-31LB
  ref <308>: DATABASE ACCESSION NUMBER: NCBI ACCESSION: NZ_QUJS01000014.1
  ref <309>: DATABASE ENTRY DATE: 2019-04-01
  ref <313>: RELEVANT RESIDUES IN SEQ ID NO: (1)..(1541)
ttaaacatgagagtttgatcctggctcaggatgaacgctggcggcgtgcctaacacatgcaagtcgaacgaagctcctgcgacagattccttcgggatgaagatgcttgagacttagtggcggacgggtgagtaacgcgtgggtaacctgccctgtactgggggacaacagttagaaatgactgctaataccgcataagcctacggagtcgcatgactcagcaggaaaaattccggtggtacaggatgggcccgcgtctgattagctagttggtgaggtaatggctcaccaaggcgacgatcagtagccggcttgagagagtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgcaggcggtctggcaagtctgatgtgaaaatccggggctcaactccggaactgcattggaaactgtcagactagagtgtcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggcacaaaagtgcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccagtccttgacatcccgatgaccgacctgtaacgaggtcttctcttcggagcatcggagacaggtggtgcatggttgtcgtcagctcgtgtcgtgagatgttgggttaagtcccgcaacgagcgcaacccctgtccttagtagccagcagttcggctgggcactctagggagactgccggggataacccggaggaaggtggggacgacgtcaaatcatcatgccccttatgggctgggctacacacgtgctacaatggtgctaacaaagtgaagcaagctggtgacagtaagcaaatcacaaaaatggcatctcagttcggattgtagtctgcaactcgactacatgaagctggaatcgctagtaatcgcagatcagaatgctgcggtgaatacgttcccgggtcttgtacacaccgcccgtcacaccatgggagttggaaatgcccgaagtcagtgacccaaccgtaaggagggagctgccgaaggcaggtctgataactggggtgaagtcgtaacaaggtagccgtatcggaaggtgcggctggatcacctcctttctaag

SEQ ID NO: 505 - DNA, 1540 bp, Clostridium sp. AM29-11AC
  ref <308>: DATABASE ACCESSION NUMBER: NCBI ACCESSION: NZ_QUJI01000004.1
  ref <309>: DATABASE ENTRY DATE: 2019-04-01
  ref <313>: RELEVANT RESIDUES IN SEQ ID NO: (1)..(1540)
taacatgagagtttgatcctggctcaggatgaacgctggcggcgtgcctaacacatgcaagtcgaacgaagcgatttggaggaagttttcggatggaatctgaattgactgagtggcggacgggtgagtaacgcgtgggtaacctgcctcacactgggggacaacagctggaaacggctgctaataccgcataagcgcacagcttcgcatgaagcagtgtgaaaaactccggtggtgtgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagaaagacggtacctgactaagaagccccggctaactacgtgccagcagccgcggtaatacgtagggggcaagcgttatccggatttactgggtgtaaagggagcgtagacggcgaagcaagtctgaagtgaaagcccggggctcaaccgcgggactgctttggaaactgttttgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggaacttaaccgttccttttcttcggaacattccagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagggaagcgaagctgtgaagctgagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttctaaggaa

SEQ ID NO: 506 - DNA, 1541 bp, Clostridium sp. AM30-24
  ref <308>: DATABASE ACCESSION NUMBER: NCBI ACCESSION: NZ_QUJB01000002.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcctaacacatgcaagtcgaacgaggtattttgattgaagttttcggatggattttaagataccgagtggcggacgggtgagtaacgcgtgggtaacctgcctcatacagggggataacggttagaaatgactgctaataccgcataagcgcacagtaccgcatggtacggtgtgaaaaactccggtggtatgagatggacccgcgtctgattagctagttggtgaggtaacggcccaccaaggcgacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaaagcctttaatcgggctcctccttcgggacagaggtgacaggtggtgcatggttgtcgtcagctcgtgtcgtgagatgttgggttaagtcccgcaacgagcgcaacccctattgtcagtagccagcaggtaaagctgggcactctgatgagactgccagggataacctggaggaaggtggggatgacgtcaaatcatcatgccccttatgatttgggctacacacgtgctacaatggcgtaaacaaagagaagcgagcctgtgagggggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctcctttctaaggaa

SEQ ID NO: 507 - DNA, 1538 bp, Clostridium sp. AM32-2
  ref <308>: DATABASE ACCESSION NUMBER: NCBI ACCESSION: NZ_QUIW01000033.1
  ref <309>: DATABASE ENTRY DATE: 2019-04-01
  ref <313>: RELEVANT RESIDUES IN SEQ ID NO: (1)..(1538)
tttaacatgagagtttgatcctggctcaggatgaacgctggcggcgtgcttaacacatgcaagtcgagcgaagcgatttaaatgagacttcggtggattttaaattgactgagcggcggacgggtgagtaacgcgtggataacctgcctcacacagggggataacagttagaaatgactgctaataccgcataagcgcacggtaccgcatggtacagtgtgaaaaactccggtggtgtgagatggatccgcgtctgattaggtagttggtgaggtaacggcccaccaagccgacgatcagtagccgacctgagagggtgaccggccacattgggactgagacacggcccaaactcctacgggaggcagcagtggggaatattgcacaatgggcgaaagcctgatgcagcaacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcactgcaagtctgaagtgaaagcccggggctcaaccccgggactgctttggaaactgtagagctagagtgctggagaggcaagcggaattcctagtgtagcggtgaaatgcgtagatattaggaagaacaccagtggcgaaggcggcttgctggacagtaactgacgttcaggctcgaaagcgtggggagcaaacaggattagataccctggtagtccacgccgtaaacgatgaatactaggtgttggtgggcaaagcccatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgtgatgaccggaacttaaccgttccttcccttcggggcatcatagacaggtggtgcatggttgtcgtcagctcgtgtcgtgagatgttgggttaagtcccgcaacgagcgcaacccttatcctcagtagccagcagtaagatgggcactctggggagactgccagggataacctggaggaaggtggggatgacgtcaaatcatcatgccccttatgatttgggctacacacgtgctacaatggcgtaaacaaagggaagcaagagggtgacctggagcaaatcccaaaaataacgtcccagttcggactgtagtctgcaacccgactacacgaagctggaatcgctagtaatcgcagatcagaatgctgcggtgaatacgttcccgggtcttgtacacaccgcccgtcacaccatgggagtcagcaacgcccgaagtcagtgactcaaccgcaaggagagagctgccgaaggcggggcaggtaactggggtgaagtcgtaacaaggtagccgtatcggaaggtgcggctggatcacctcctttctaaggaa

SEQ ID NO: 508 - DNA, 1094 bp, Clostridium sp. AM33-3
  ref <308>: DATABASE ACCESSION NUMBER: NCBI ACCESSION: NZ_QUIV01000015.1
  ref <309>: DATABASE ENTRY DATE: 2019-04-01
  ref <313>: RELEVANT RESIDUES IN SEQ ID NO: (1)..(1094)
ttttatttgagagtttgatcctggctcaggatgaacgctggcggcgtgcttaacacatgcaagtcgagcgaagcacttatgaaagattcttcggatgatttcatttgtgactgagcggcggacgggtgagtaacgcgtgggtaacctgcctcatacagggggataacagttggaaacgactgctaataccgcataagcgcacagtaccgcatggtacagtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgagacaagtctgaagtgaaagcccggggctcaaccccgggactgctttggaaactgccttgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatcccgatgaaaagtccttaaccggactccctcttcggagcatcggtgacaggtggtgcatggttgtcgtcagctcgtgtcgtgagatgttgggttaagtcccgcaac

SEQ ID NO: 509 - DNA, 1541 bp, Clostridium sp. AM43-3BH
  ref <308>: DATABASE ACCESSION NUMBER: NCBI ACCESSION: NZ_QUIH01000007.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcaatttaacggaagttttcggatggaagctagattgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaggcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgaaaggagggagctgccgaaggcaggaccgataactggggtgaagtcgtaacaaggtagccgtatcggaaggtgcggctggatcacctcctttctaaggaa

SEQ ID NO: 510 - DNA, 1539 bp, Clostridium sp. AM45-5
  ref <308>: DATABASE ACCESSION NUMBER: NCBI ACCESSION: NZ_QUIE01000063.1
  ref <309>: DATABASE ENTRY DATE: 2019-04-01
  ref <313>: RELEVANT RESIDUES IN SEQ ID NO: (1)..(1539)
tttaacatgagagtttgatcctggctcaggatgaacgctggcggcgtgcctaacacatgcaagtcgaacgaggtaaatgagatgaagttttcggatggattcttatttaccgagtggcggacgggtgagtaacgcgtgggtaacctgcctcatacagggggataacgattggaaacgattgctaataccgcataagcgcacagtaccacatggtacagtgtgaaaaactccggtggtatgagatggacccgcgtctgattagctagttggtgaggtaacggcccaccaagcaacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaatacccgggctcaacctgggaactgctttggaaactgtatggctagagtgctggagaggtaagcggaattcctagtgtagcggtgaaatgcgtagatattaggaagaacaccagtggcgaaggcggcttactggacagtaactgacgttcaggctcgaaagcgtggggagcaaacaggattagataccctggtagtccacgccgtaaacgatgaatactaggtgtcgggggacaaagtctttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaacactcttaatcgagtgcctccttcgggacagaggtgacaggtggtgcatggttgtcgtcagctcgtgtcgtgagatgttgggttaagtcccgcaacgagcgcaacccctattgtcagtagccagcagttcggctgggcactctgatgagactgccagggataacctggaggaaggtggggatgacgtcaaatcatcatgccccttatgatttgggctacacacgtgctacaatggcgtaaacaaagagaagcgaagctgtgaggcagagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctcctttctaaggaa

SEQ ID NO: 511 - DNA, 1527 bp, Clostridium sp. AM46-21
  ref <308>: DATABASE ACCESSION NUMBER: NCBI ACCESSION: NZ_QUIB01000027.1
  ref <309>: DATABASE ENTRY DATE: 2019-04-01
  ref <313>: RELEVANT RESIDUES IN SEQ ID NO: (1)..(1527)
tttaatgagagtttgatcctggctcaggatgaacgctggcggcgtgcttaacacatgcaagtcgaacgagagaagattggtgcttgcactgatccgatcgagtggcggacgggtgagtaacgcgtgggtaacctgcctcatacaggggaataacagttggaaacggctgctaaaaccgcataagcgcacagtatcgcatgatacagtgtgaaaaactccggtggtatgagatggacccgcgtctgattagctagttggtgaggtaacggcccaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagccaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaaccggaattttccttcgggacagcagagacaggtggtgcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 512 - DNA, 1426 bp, Clostridium sp. AM48-13
  ref <308>: DATABASE ACCESSION NUMBER: NCBI ACCESSION: NZ_QUFD01000061.1
  ref <309>: DATABASE ENTRY DATE: 2019-04-01
  ref <313>: RELEVANT RESIDUES IN SEQ ID NO: (1)..(1426)
attgactgagtggcggacgggtgagtaacgcgtgggtaacctgcctcacactgggggacaacagttagaaatgactgctaataccgcataagcgcacaggaccgcatggtctagtgtgaaaaactccggtggtgtgagatggacccgcgtttgattagctagttggtggggtaacggcctaccaagcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgtaaggagggagctgccgaaggcaggaccgataactggggtgaagtcgtaacaaggtagccgtatcggaaggtgcggctggatcacctcctt

SEQ ID NO: 513 - DNA, 1540 bp, Clostridium sp. AM49-4BH
  ref <308>: DATABASE ACCESSION NUMBER: NCBI ACCESSION: NZ_QUFB01000015.1
  ref <309>: DATABASE ENTRY DATE: 2019-04-01
  ref <313>: RELEVANT RESIDUES IN SEQ ID NO: (1)..(1540)
ttaaacatgagagtttgatcctggctcaggatgaacgctggcggcgtgcctaacacatgcaagtcgaacgaagacataccgacggaatccttcgggaggaagatggtatggactgagtggcggacgggtgagtaacgcgtgggtaacctgccctgtacagggggacaacagttagaaatgactgctaataccgcataagcgcacagtaccgcatggtacagtgcgaaaaactccggtggtacaggatgggcccgcgtctgattagttagttggcggggtaacggcccaccaagacgacgatcagtagccggcttgagagagtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcaggcggtgcggcaagtcagatgtgaaaacccggggctcaaccccgggactgcatttgaaactgtcggactagagtgccggagaggtaagtggaattcctagtgtagcggtgaaatgcgtagatattaggaggaacaccagtggcgaaggcggcttactggacggtaactgacgctgaggctcgaaagcgtggggagcaaacaggattagataccctggtagtccacgccgtaaacgatgaatactaggtgtcggggcacataagtgcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccagtccttgacatccaactgaccgaccagtaacgtggtcttctcttcggagcagttgagacaggtggtgcatggttgtcgtcagctcgtgtcgtgagatgttgggttaagtcccgcaacgagcgcaacccctatccttagtagccagcagtaagatgggaactctagggagactgccggggataacccggaggaaggtggggacgacgtcaaatcatcatgccccttatgggctgggctacacacgtgctacaatggtgctaacagagtgaggcgagactgtgaagttaagcaaatcacaaaaatggcatctcagttcggattgtagtctgcaactcgactacatgaagctggaatcgctagtaatcgcagatcagaatgctgcggtgaatacgttcccgggtcttgtacacaccgcccgtcacaccatgggagttgggaatgcccgaagccggtgacctaaccgtaaggaaggagccgtcgaaggcaggctcgataactggggtgaagtcgtaacaaggtagccgtatcggaaggtgcggctggatcacctcctttctaag

SEQ ID NO: 514 - DNA, 893 bp, Clostridium sp. AM51-4
  ref <308>: DATABASE ACCESSION NUMBER: NCBI ACCESSION: NZ_QUEZ01000071.1
  ref <309>: DATABASE ENTRY DATE: 2019-04-01
  ref <313>: RELEVANT RESIDUES IN SEQ ID NO: (1)..(893)
gagctagagtgctggagaggcaagcggaattcctagtgtagcggtgaaatgcgtagatattaggaagaacaccagtggcgaaggcggcttgctggacagtaactgacgttcaggctcgaaagcgtggggagcaaacaggattagataccctggtagtccacgccgtaaacgatgaatactaggtgttggtgggcaaagcccatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgtgatgaccggaacttaaccgttccttcccttcggggcatcatagacaggtggtgcatggttgtcgtcagctcgtgtcgtgagatgttgggttaagtcccgcaacgagcgcaacccttatcctcagtagccagcagtaagatgggcactctggggagactgccagggataacctggaggaaggtggggatgacgtcaaatcatcatgccccttatgatttgggctacacacgtgctacaatggcgtaaacaaagggaagcgatagggtgacctggagcaaatcccaaaaataacgtcccagttcggactgtagtctgcaacccgactacacgaagctggaatcgctagtaatcgcagatcagaatgctgcggtgaatacgttcccgggtcttgtacacaccgcccgtcacaccatgggagtcagcaacgcccgaagtcagtgacctaaccgaaagggaggagctgccgaaggcggggcaggtaactggggtgaagtcgtaacaaggtagccgtatcggaaggtgcggctggatcacctcctt

SEQ ID NO: 515 - DNA, 1527 bp, Clostridium sp. AM54-14XD
  ref <308>: DATABASE ACCESSION NUMBER: NCBI ACCESSION: NZ_QUEW01000023.1
  ref <309>: DATABASE ENTRY DATE: 2019-04-01
  ref <313>: RELEVANT RESIDUES IN SEQ ID NO: (1)..(1527)
tttaatgagagtttgatcctggctcaggatgaacgctggcggcgtgcttaacacatgcaagtcgaacgagagaagattggtgcttgcactgatccgatcgagtggcggacgggtgagtaacgcgtgggtaacctgcctcatacaggggaataacagttggaaacggctgctaaaaccgcataagcgcacggtatcgcatgatacagtgtgaaaaactccggtggtatgagatggacccgcgtctgattagctagttggtgaggtaacggcccaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagccaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaaccggaattttccttcgggacagcagagacaggtggtgcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 516 - DNA, 1526 bp, Clostridium sp. AM54-37XD
  ref <308>: DATABASE ACCESSION NUMBER: NCBI ACCESSION: NZ_QUEV01000021.1
  ref <309>: DATABASE ENTRY DATE: 2019-04-01
  ref <313>: RELEVANT RESIDUES IN SEQ ID NO: (1)..(1526)
tttaatgagagtttgatcctggctcaggatgaacgctggcggcgtgcttaacacatgcaagtcgaacgagagaagatcggtgcttgcactgatccgatcgagtggcggacgggtgagtaacgcgtgggtaacctgcctcatacaggggaataacagttggaaacggctgctaaaaccgcataagcgcacggtatcgcatgatacagtgtgaaaaactccggtggtatgagatggacccgcgtctgattagctagttggtgaggtaacggcccaccaagcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagccaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaaccggaattttccttcgggacagcagagacaggtggtgcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 517 - DNA, 1540 bp, Clostridium sp. AM58-1XD
  ref <308>: DATABASE ACCESSION NUMBER: NCBI ACCESSION: NZ_QSDR01000063.1
  ref <309>: DATABASE ENTRY DATE: 2019-04-01
  ref <313>: RELEVANT RESIDUES IN SEQ ID NO: (1)..(1540)
tttaacatgagagtttgatcctggctcaggatgaacgctggcggcgtgcctaacacatgcaagtcgagcgaagcgattgagaggaagttttcggatggaatcttgattgactgagcggcggacgggtgagtaacgcgtgggtaacctgcctcatacagggggataacagttagaaatgactgctaataccgcataagcgcacagtgccacatggcacagtgtgaaaaactccggtggtatgagatggacccgcgtctgattagctagttggtagggtaacggcctaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaagcccggggctcaaccccggtactgctttggaaactgtacggctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttggtgggcaaagcccatcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggtacgtaatggtaccttcccttcggggcagaggagacaggtggtgcatggttgtcgtcagctcgtgtcgtgagatgttgggttaagtcccgcaacgagcgcaacccttatccttagtagccagcagtaagatgggaactctagggagactgccagggataacctggaggaaggtggggatgacgtcaaatcatcatgccccttatgatttgggctacacacgtgctacaatggcgtaaacagagggaagcgagagggtgacctggagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgaaaggagggagctgccgaaggcgggaccgataactggggtgaagtcgtaacaaggtagccgtatcggaaggtgcggctggatcacctcctttctaaggaa

SEQ ID NO: 518 - DNA, 1539 bp, Clostridium sp. ASF502
  ref <308>: DATABASE ACCESSION NUMBER: NCBI ACCESSION: NZ_KB822463.1
  ref <309>: DATABASE ENTRY DATE: 2019-04-01
  ref <313>: RELEVANT RESIDUES IN SEQ ID NO: (1)..(1539)
taacgagagtttgatcctggctcaggatgaacgctggcggcgtgcttaacacatgcaagtcgagcgaagcacttttttagaactcttcggagggaagagagggtgacttagcggcggacgggtgagtaacgcgtgggcaacctgccttacacagggggataacaattagaaatgattgctaataccgcataagaccccgataccgcatggtacagaggtaaaaactgaggtggtgtaagatgggcccgcgtctgattaggtagttggtggggtagaagcctaccaagccgacgatcagtagccgacctgagagggcgaccggccacattgggactgagacacggcccaaactcctacgggaggcagcagtggggaatattgcacaatgggggaaaccctgatgcagcgacgccgcgtgagtgaggaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggataagcaagtctggtgtgaaaatccggggcccaaccccggaattgcattggaaactgcatatctagagtgtcggagaggcaagtggaattcctggtgtagcggtgaaatgcgtagatatcaggaggaacaccagtggcgaaggcggcttgctggacgatgactgacgttgaggctcgaaagcgtggggagcaaacaggattagataccctggtagtccacgccgtaaacgatgactactaggtgtcgggaggcaaagcctttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctggccttgacatcccggtgacagcgaagtaatgttcgttttccttcgggacactggagacaggtggtgcatggttgtcgtcagctcgtgtcgtgagatgttgggttaagtcccgcaacgagcgcaacccttaccttcagtagccagcatttaggatgggcactctggagggactgccagggacaacctggaggaaggtggggatgacgtcaaatcatcatgccccttatggccagggctacacacgtgctacaatggcgtaaacaaagagaagcgaccacgcgagtgtgagcgaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagccggtgacccaacctaagcaggagggagccgtcgaaggcgggacggatgactggggtgaagtcgtaacaaggtagccgtatcggaaggtgcggctggatcacctcctttctaaggaa

SEQ ID NO: 519 - DNA, 1540 bp, Clostridium sp. AT4
  ref <308>: DATABASE ACCESSION NUMBER: NCBI ACCESSION: NZ_LN999825.1
  ref <309>: DATABASE ENTRY DATE: 2019-04-01
  ref <313>: RELEVANT RESIDUES IN SEQ ID NO: (1)..(1540)
ttaaacatgagagtttgatcctggctcaggatgaacgctggcggcgtgcctaacacatgcaagtcgagcgaagcggttttaaggaagttttcggatggaattaaaactgactgagcggcggacgggtgagtaacgcgtgggtaacctgcctcatacagggggataacagttagaaatggctgctaataccgcataagcacacagcttcgcatggagcagtgtgaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcggagcaagtctgaagtgaaagcccggggctcaaccccgggactgctttggaaactgttctgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatgctaggtgttggagggcaaagcccttcggtgccgccgcaaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggacagtaatgtgtcctttccttcgggacaggggagacaggtggtgcatggttgtcgtcagctcgtgtcgtgagatgttgggttaagtcccgcaacgagcgcaacccttatccttagtagccagcagtaagatgggcactctagggagactgccagggataacctggaggaaggtggggatgacgtcaaatcatcatgccccttatgatttgggctacacacgtgctacaatggcgtaaacaaagagaagcgagcctgcgagggggagcgaatctcaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagcaacgcccgaagtcagtgactcaaccgcaaggagagagctgccgaaggcggggcaggtaactggggtgaagtcgtaacaaggtagccgtatcggaaggtgcggctggatcacctcctttctaaggaa

SEQ ID NO: 520 - DNA, 1515 bp, Clostridium sp. AWRP
  ref <308>: DATABASE ACCESSION NUMBER: NCBI ACCESSION: NZ_CP029758.1
  ref <309>: DATABASE ENTRY DATE: 2019-04-01
  ref <313>: RELEVANT RESIDUES IN SEQ ID NO: (1)..(1515)
tttaaattaagagtttgatcctggctcaggacgaacgctggcggcgtgcttaacacatgcaagtcgagcgatgaagctccttcgggagtggattagcggcggacgggtgagtaacacgtgggtaacctacctcaaagagggggatagcctcccgaaagggagattaataccgcataataatcaattttcacatgaaaactgatttaaaggagtaatccgctttgagatggacccgcggcgcattagctagttggtagggtaacggcctaccaaggcgacgatgcgtagccgacctgagagggtgatcggccacattggaactgagagacggtccagactcctacgggaggcagcagtggggaatattgcacaatgggcgaaagcctgatgcagcaacgccgcgtgagtgaagaaggttttcggattgtaaagctctgtctttggggacgataatgacggtacccaaggaggaagccacggctaactacgtgccagcagccgcggtaatacgtaggtggcgagcgttgtccggaattactgggcgtaaagagtgcgtaggcggatatttaagtgagatgtgaaatacccgggcttaacccgggcactgcatttcaaactgggtatctggagtgcgggagaggagaatggaattcctagtgtagcggtgaaatgcgtagagattaggaagaacaccagtggcgaaggcgattctctggaccgtaactgacgctgaggcacgaaagcgtgggtagcaaacaggattagataccctggtagtccacgccgtaaacgatgagtactaggtgtaggaggtatcgaccccttctgtgccgcagtaaacacaataagtactccgcctgggaagtacgatcgcaagattaaaactcaaaggaattgacgggggcccgcacaagcagcggagcatgtggtttaattcgaagcaacgcgaagaaccttacctggacttgacataccctgaatatcttagagataagagaagcccttcggggcagggatacaggtggtgcatggttgtcgtcagctcgtgtcgtgagatgttaggttaagtcctgcaacgagcgcaacccctgttgttagttgctaacatttagttgagcactctagcaagactgccgcggttaacgcggaggaaggtggggatgacgtcaaatcatcatgccccttatgtccagggcaacacacgtgctacaatgggcagtacagagagaagcaagaccgcaaggtggagcaaacctcaaaaactgcccccagttcggattgcaggctgaaactcgcctgcatgaagttggagttgctagtaatcgcgaatcagaatgtcgcggtgaatacgttcccgggccttgtacacaccgcccgtcacaccatgagagctggcaacacccgaagtccgtagtctaacttaggaggacgcggccgaaggtggggttagtaattggggtgaagtcgtaacaaggtagccgtaggagaacctgcggctggatcacctcctttcta

SEQ ID NO: 521 - DNA, 1657 bp, Clostridium sp. BNL1100
  ref <308>: DATABASE ACCESSION NUMBER: NCBI ACCESSION: NC_016791.1
  ref <309>: DATABASE ENTRY DATE: 2019-04-01
  ref <313>: RELEVANT RESIDUES IN SEQ ID NO: (1)..(1657)
ttaatttgagagtttgatcctggctcaggacgaacgctggcggcgtgcctaacacatgcaagtcgagcggagttacctttagcactgagtattcttaattatttgatgctggccgacagcgtcatgcaaaaacaaccttaataaattatttaattagagtttttgcatcacgcgttttatcaaagtgtcaacacataatatagaagagaatgttcagtgctgaaggtaacttagcggcggacgggtgagtaacgcgtgggcaacctgcctgttacagggggataacacagggaaacttgtgctaataccgcataatacagcgagaaagcattttcttgttgtcaaaggagcaatccggtaacagatgggcccgcgtccaattagctagttggtgatgtaacggaccaccaaggcgacgattggtagccgaactgagaggttgatcggccacattgggactgagacacggcccagactcctacgggaggcagcagtggggaatattgcacaatgggggaaaccctgatgcagcaacgccgcgtgaaggatgaaggttttcggattgtaaacttctttagtcagggacgaaaaaatgacggtacctgaagaataagccacggctaactacgtgccagcagccgcggtaatacgtaggtggcaagcgttgtccggaattactgggtgtaaagggcgtgtaggcgggaatgtaagtcagatgtgaaatcccagagcttaactctggagctgcatctgaaactatgtttcttgagtgccggagaggaaagcggaattcctagtgtagcggtgaaatgcgtagatattaggaggaacaccagtggcgaaggcggctttctggacggtaactgacgctgaggcgcgaaagcgtggggagcaaacaggattagataccctggtagtccacgctgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccaaggcttgacatatagcggaatacggcagagatgtcgtagtccttcgggactgctatacaggtggtgcatggttgtcgtcagctcgtgtcgtgagatgttgggttaagtcccgcaacgagcgcaacccctgttgctagttgataacatttagttgatcactctagcgagactgccggtgataaatcggaggaaggtggggacgacgtcaaatcatcatgccccttatgtcttgggctacacacgtactacaatggctataacagagggaagctaagctgcaaagtggagcaaatccccaaaaatagtcccagttcagattgtgggctgcaacccgcccacatgaagtcggaattgctagtaatggcaggtcagcatactgccgtgaatacgttcccgggccttgtacacaccgcccgtcacaccatgagagtctgcaacacccgaagtcgatagtctaaccgtaaggaggacgtcgccgaaggtggggccgatgattggggtgaagtcgtaacaaggtagccgtatcggaaggtgcggctggatcacctcctttcta

SEQ ID NO: 522 - DNA, 1516 bp, Clostridium sp. C105KSO13
  ref <308>: DATABASE ACCESSION NUMBER: NCBI ACCESSION: NZ_FBWL01000107.1
  ref <309>: DATABASE ENTRY DATE: 2019-04-01
  ref <313>: RELEVANT RESIDUES IN SEQ ID NO: (1)..(1516)
tttatacgagagtttgatcctggctcaggatgaacgctggcggcgtgcttaacacatgcaagtcgagcgaagcgctttactttgatttcttcggaaggaagagtatagtgactgagcggcggacgggtgagtaacgcgtggataacctgcctcatacagggggataacagtcagaaatgactgctaataccgcataagaccacggtaccgcatggtacagtgggaaaaacttaaggtggtatgagatggatccgcgtctgattagcttgttggtaaggtaacggcttaccaaggcgacgatcagtagccggcctgagagggcgaccggccacattgggactgagacacggcccaaactcctacgggaggcagcagtggggaatattgcacaatgggggaaaccctgatgcagcgacgccgcgtgaaggatgaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgatgtgaaaacccggggctcaaccccgggactgcattggaaactgtgcagctcgagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggaagcaaagcttttcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgccttttctacggaacaggggagacaggtggtgcatggttgtcgtcagctcgtgtcgtgagatgttgggttaagtcccgcaacgagcgcaacccttatcttcagtagccagcattttaggtgggcactctggagagactgccagggataacctggaggaaggcggggatgacgtcaaatcatcatgccccttatgagcagggctacacacgtgctacaatggcgtaaacaaagggaagcgaccccgcgagggcaggcaaatcccaaaaataacgtcccagttcggattgtagtctgcaactcgactacatgaagctggaatcgctagtaatcgcagatcagaatgctgcggtgaatacgttcccgggtcttgtacacaccgcccgtcacaccatggaagtcggtaacgcccgaagtcagtgacccaaccgtaaggagggagctgccgaaggcgggaccgataactggggtgaagtcgtaacaaggtagccgtatcggaaggtg

SEQ ID NO: 523 - DNA, 1543 bp, Clostridium sp. C105KSO14
  ref <308>: DATABASE ACCESSION NUMBER: NCBI ACCESSION: NZ_FBWO01000165.1
  ref <309>: DATABASE ENTRY DATE: 2019-04-01
  ref <313>: RELEVANT RESIDUES IN SEQ ID NO: (1)..(1543)
tttgaacatgagagtttgatcctggctcaggatgaacgctggcggcgtgcctaacacatgcaagtcgaacgaagcaattaagatgaagttttcggatggaatcttgattgactgagtggcggacgggtgagtaacgcgtggataacctgcctcacactgggggataacagttagaaatgactgctaataccgcataagcgcacagtgccgcatggcagtgtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgccgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatccccctgacgggccggtaacgcggcctttccttcgggacaggggagacaggtggtgcatggttgtcgtcagctcgtgtcgtgagatgttgggttaagtcccgcaacgagcgcaacccttatccttagtagccagcaggtagagccgggcactctagggagactgccagggataacctggaggaaggtggggatgacgtcaaatcatcatgccccttatgatttgggctacacacgtgctacaatggcgtaaacaaagggaagcgagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaa

SEQ ID NO: 524 - DNA, 1542 bp, Clostridium sp. C105KSO15
  ref <308>: DATABASE ACCESSION NUMBER: NCBI ACCESSION: NZ_FBWN01000103.1
  ref <309>: DATABASE ENTRY DATE: 2019-04-01
  ref <313>: RELEVANT RESIDUES IN SEQ ID NO: (1)..(1542)
tttaatttgagagttcgatcctggctcaggatgaacgctggcggcgtgcttaacacatgcaagtcgagcgaagcgattcaaatgaagttttcggacggattttgaattgacttagcggcggacgggtgagtaacgcgtgggtaacctgcctcatacagggggataacagttggaaacggctgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccgggactgctttggaaactgtggtgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgggatgtaacgatcccttcccttcggggcattccagacaggtggtgcatggttgtcgtcagctcgtgtcgtgagatgttgggttaagtcccgcaacgagcgcaacccttatccttagtagccagcaagtcaagttgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 525 - DNA, 1514 bp, Clostridium sp. CL-2
  ref <308>: DATABASE ACCESSION NUMBER: NCBI ACCESSION: NZ_LM994668.1
  ref <309>: DATABASE ENTRY DATE: 2019-04-01
  ref <313>: RELEVANT RESIDUES IN SEQ ID NO: (1)..(1514)
attgagagtttgatcctggctcaggacgaacgctggcggcatgcctaacacatgcaagtcgagcgagtggagttcttcggaacaaagctagcggcggacgggtgagtaacacgtgggcaacctgcctcatagaggggaatagcctcccgaaagggagattaataccgcataagattgtagcttcgcatgaagtagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaatgccgcgtgagtgatgacggccttcgggttgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatttttaagtgagatgtgaaatacccgggcttaacttgggtgctgcatttcaaactggaagtctagagtgcaggagaggagaagggaattcctagtgtagcggtgaaatgcgtagagattaggaagaacaccagtggcgaaggcgcttctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaactggggaagtcgcttcggcgacaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagtgcgtgatctaactcgcaagagaggaagcgccctaaggtagggtcagcgattggggtgaagtcgtaacaaggtagccgtaggagaacctgcggctggatcacctcctttcta

SEQ ID NO: 526 - DNA, 1528 bp, Clostridium sp. CT4
  ref <308>: DATABASE ACCESSION NUMBER: NCBI ACCESSION: NZ_CP025746.1
  ref <309>: DATABASE ENTRY DATE: 2019-04-01
  ref <313>: RELEVANT RESIDUES IN SEQ ID NO: (1)..(1528)
tttaaattgagagtttgatcctggctcaggacgaacgctggcggcgtgcctaacacatgcaagtcgagcggagaaagttcttcggaactttcttagcggcggacgggtgagtaacacgtgggtaacctgccttatagagggggatagccttccgaaaggaagattaataccgcataacattttcgtttcgcatgaaatgaaaatcaaaggagcaatccgctataagatggacccgcggtgcattagctagttggtgaggtaatggctcaccaaggcgacgatgcgtagccgacctgagagggtgatcggccacattggaactgagatacggtccagactcctacgggaggcagcagtggggaatattgcacaatggggaaaccctgatgcgagcaacgccgcgtgagtgatgaaggccttcgggttgtaaagctctgtctttggggacgataatgacggtacccaaggaggaagccacggctaactacgtgccagcgtaccgcggtaatacgtaggtggcaagcgttgtccggatttactgggcgtaaagggagcgtaggtggatgtttaagtgggatgtgaaatacctgggcttaacttgggtgctcgcattccaaactggatatctagagtgcaggagaggaaagtggaattcctagtgtagcggtgaaatgcgtagagattaggaagaacaccagtggcgaaggcgactttctggactgtaactgacactgaggctcgaaagcgtggggagcaaacaggattagataccctggtagtccacgccgtaaacgatggatactaggtgtggggtttcaacacctccgtgccgccgttaacacaataagtatcccgcctggggagtacggtcgcaagattaaaactcaaaggaattgacgggggcccgcacaagcagcggagcatgtggtttaattcgaagcaacgcgaagaaccttacctagacttgacatctcctgaattacccttaaccggggaagtcggtacctttggtatcgacaggaagacagagtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagacgcaagaccgtgaggtggagcaaatctcaaaaaacttgtcccagttcggattgtaggctgaaactcgcctacatgaagccggagttgctagtaatcgcgaatcagcatgtcgcggtgaatacgttcccgggccttgtacacaccgcccgtcacaccatgagagttggcaatacccgaagtctgtgagctaacccgtaagggaggcagcagccgaaggtagggtcagcgattggggtgaagtcgtaacaaggtagccgtaggagaacctgcggctggatcacctcctttcta

SEQ ID NO: 527 - DNA, 1510 bp, Clostridium sp. CT7
  ref <308>: DATABASE ACCESSION NUMBER: NCBI ACCESSION: NZ_PETE01000002.1
  ref <309>: DATABASE ENTRY DATE: 2019-04-01
  ref <313>: RELEVANT RESIDUES IN SEQ ID NO: (1)..(1510)
tttaaattgagagtttgatcctggctcaggacgaacgctggcggcgtgcttaacacatgcaagtcgagcggggaacttcggttcccagcggcggacgggtgagtaacacgtgggtaacctgccttacagtggggaatagccttccgaaaggaagattaataccgcataatactcagagatcacatgatctttgagccaaaggatttattcgctgtaagatggacccgcggcgcattagcttgttggtgaggtaacggctcaccaaggctgcgatgcgtagccgacctgagagggtgatcggccacattggaactgagacacggtccagactcctacgggaggcagcagtggggaatattgcacaatggaggaaactctgatgcagcaacgccgcgtgagtgatgaaggtcttcggatcgtaaaactctgtcttatgggacgataatgacggtaccataggaggaagccacggctaactacgtgccagcagccgcggtaatacgtaggtggcaagcgttgtccggatttactgggcgtaaaggatgtgtaggcggatatttaagtgagatgtgaaatccccgggcttaacttgggggctgcatttcaaactggatgtctagagtgcaggagaggaaagcagaattcctagtgtagcggtgaaatgcgtagagattaggaagaataccggtggcgaaggcggctttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattactcgtaactgaggaaatcccttcggggacaggaagacaggtggtgcatggttgtcgtcagctcgtgtcgtgagatgttgggttaagtcccgcaacgagcgcaacccttatcattagttgctaacattaagttgagcactctagtgagactgcctgggttaaccaggaggaaggtggggatgacgtcaaatcatcatgccccttatgtctagggccacacacgtgctacaatggtggggacagaaagatgcgaaaccgcaaggctgagccaaactaaaaaccccatcccagttcggattgtaggctgaaactcgcctacatgaagccggagttgctagtaatcgcgaatcagaatgtcgcggtgaatacgttcccgggtcttgtacacaccgcccgtcacaccatgagagtcggcaacacccgaagcccgtgaggtaaccttttggaaccagcggtcgaaggtggggttgataattggggtgaagtcgtaacaaggtagccgtaggagaacctgcggctggatcacctcctttcta

SEQ ID NO: 528 - DNA, 1541 bp, Clostridium sp. D5
  ref <308>: DATABASE ACCESSION NUMBER: NCBI ACCESSION: NZ_GL870827.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgagcgaagcgctttacttagatttcttcggattgaagagttttgcgactgagcggcggacgggtgagtaacgcgtgggtaacctgcctcatacagggggataacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatcactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctgctcttgacatcccactgaccggcgtgtaatggcgccttcccttcggggcagtggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggtggggatgacgtcaaatcatcatgccccttatgagcagggctacacacgtgctacaatggcgtaaacaaagggaggcaataccgcgaggttgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggcgggatcgataactggggtgaagtcgtaacaaggtagccgtatcggaaggtgcggctggatcacctcctttctaaggaa

SEQ ID NO: 529 - DNA, 1519 bp, Clostridium sp. DL-VIII
  ref <308>: DATABASE ACCESSION NUMBER: NCBI ACCESSION: NZ_CM001240.1
  ref <309>: DATABASE ENTRY DATE: 2019-04-01
  ref <313>: RELEVANT RESIDUES IN SEQ ID NO: (1)..(1519)
ttttaattgagagtttgatcctggctcaggacgaacgctggcggcgtgcttaacacatgcaagtcgagcgagagaaattccttcgggaaggactctagcggcggacgggtgagtaacacgtgggtaacctgcctcatagaggggaatagccttccgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtgggggttgtcatgacctccgtgccgccgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagcccttcggggcaggaagacaggtggtgcatggttgtcgtcagctcgtgtcgtgagatgttgggttaagtcccgcaacgagcgcaacccttattgttagttgctaccattaagttgagcactctagcgagactgcccgggttaaccgggaggaaggtggggatgacgtcaaatcatcatgccccttatgtctagggctacacacgtgctacaatggctggtacagagagatgctaaaccgtgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctttcta

SEQ ID NO: 530 - DNA, 1538 bp, Clostridium sp. E02
  ref <308>: DATABASE ACCESSION NUMBER: NCBI ACCESSION: NZ_RJLQ01000050.1
  ref <309>: DATABASE ENTRY DATE: 2019-04-01
  ref <313>: RELEVANT RESIDUES IN SEQ ID NO: (1)..(1538)
aatttgagagtttgatcctggctcaggatgaacgctggcggcgtgcttaacacatgcaagtcgagcgaagcactttaaaggaagttttcggatggaatttaaagtgacttagcggcggacgggtgagtaacgcgtgggtaacctgcctcatacagggggataacagttagaaatgactgctaataccgcataagcgcacagtgctgcatagcacagtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgactgaagaagtatttcggtatgtaaaggtctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaagcccggggctcaaccccgggactgctttggaaactgtgttgctagagtgcaggagaggtaagtggaattcctagtgtagcggtgaaatgcgtagatattaggaggaacaccagtggcgaaggcggcttactggactgtaactgacgttgaggctcgaaagcgtggggagcgaacaggattagataccctggtagtccacgccgtaaacgatgaatactaggtgtcggggagcaaagctcttcggtgccgtcgctaacgcagtaagtattccacctggggagtacgttcgcaagaatgaaactcaaaggaattgacggggacccgcacaagcggtggagcatgtggtttaattcgaagcaacgcgaagaaccttaccaagtcttgacatcggaatgatcgtcctgtaaccagggcttccctacggggcattctagacaggtggtgcatggttgtcgtcagctcgtgtcgtgagatgttgggttaagtcccgcaacgagcgcaacccttatccttagtagccagcagttcggctgggcactctggggagactgccagggataacctggaggaaggtggggatgacgtcaaatcatcatgccccttatgatttgggctacacacgtgctacaatggcgtaaacaaagggaagcgaagccgtgaggtgaagcaaatcccataaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctcctttctaaggaa

SEQ ID NO: 531 - DNA, 1541 bp, Clostridium sp. HMb25
  ref <308>: DATABASE ACCESSION NUMBER: NCBI ACCESSION: NZ_PDDG01000001.1
  ref <309>: DATABASE ENTRY DATE: 2019-04-01
  ref <313>: RELEVANT RESIDUES IN SEQ ID NO: (1)..(1541)
ttaaacatgagagtttgatcctggctcaggatgaacgctggcggcgtgcctaacacatgcaagtcgaacgaagcgatttaacggaagttttcggatggaagttggattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagacaggtggtgcatggttgtcgtcagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttctaaggaa

SEQ ID NO: 532 - DNA, 1517 bp, Clostridium sp. JN-1
  ref <308>: DATABASE ACCESSION NUMBER: NCBI ACCESSION: NZ_CP033465.1
  ref <309>: DATABASE ENTRY DATE: 2019-04-01
  ref <313>: RELEVANT RESIDUES IN SEQ ID NO: (1)..(1517)
ttaaattgagagtttgatcctggctcaggacgaacgctggcggcgtgcctaacacatgcaagtcgagcgagagaaattccttcgggaatggatctagcggcggacgggtgagtaacacgtgggcaacctgcctcaaagagggggatagcctcccgaaagggagattaataccgcataaagttattttatcgcatggtaaaataaccaaaggagaaatccactttgagatgggcccgcggcgcattagctagttggtaaggtaacggcttaccaaggcagcgatgcgtagccgacctgagagggtaatcggccacattggaactgagagacggtccagactcctacgggaggcagcagtggggaatattgcacaatgggcgaaagcctgatgcagcaacgccgcgtgggtgatgaaggttttcggattgtaaagccctgtcttttgggacgataatgacggtaccaaaggaggaagccacggctaactacgtgccagcagccgcggtaatacgtaggtggcgagcgttgtccggatttactgggcgtaaagggtgcgtaggcggatatttaagtgggatgtgaaaaccccgggctcaacctggggactgcatttcaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatgagtactaggtgtaggaggtatcgaccccttctgtgccgcagtaaacgcagtaagtactccgcctgggaagtacgatcgcaagattaaaactcaaaggaattgacgggggcccgcacaagcagcggagcatgtggtttaattcgaagcaacgcgaagaaccttacctagacttgacatcccctgaattacctgtaattagggaagcccttcggggcagggagacaggtggtgcatggttgtcgtcagctcgtgtcgtgagatgttaggttaagtcctgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtgaatacagagagatgcaaacccgcgagggtgagccaaacttcaaaattcacctcagttcggattgcaggctgaaacccgcctgcatgaagctggagttgctagtaatcgcgaatcagaatgccgcggtgaatgcgttcccgggccttgtacacaccgcccgtcacaccatgagagttggcaacacccgaagtccgtggggcaaccgtaaggggccagcggccgaaggtggggttaataattggggtgaagtcgtaacaaggtagccgtaggagaacctgcggctggatcacctcctttcta

SEQ ID NO: 533 - DNA, 1517 bp, Clostridium sp. JN-9
  ref <308>: DATABASE ACCESSION NUMBER: NCBI ACCESSION: NZ_CP035280.1
  ref <309>: DATABASE ENTRY DATE: 2019-04-01
  ref <313>: RELEVANT RESIDUES IN SEQ ID NO: (1)..(1517)
tttaaattgagagtttgatcctggctcaggacgaacgctggcggcgtgcttaacacatgcaagtcgagcgatgaagtcccttcggggacggattagcggcggacgggtgagtaacacgtgggcaacctgcctcaaagagggggatagcctcccgaaagggagattaataccgcataacattagagcatcacatgatgttctaatcaaaggagtaatccgctttgagatgggcccgcggcgcattagctagttggtgaggtaacggctcaccaaggcaacgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggattgtaaagctctgtcttttgggacgataatgacggtaccaaaggaggaagccacggctaactacgtgccagcagccgcggtaatacgtaggtggcaagcgttgtccggatttactgggcgtaaagggtgcgtaggcggatgtttaagtgagatgtgaaatacccgggcttaacttgggtactgcatttcaaactggatatctagagtgcaggagaggagaatggaattcctagtgtagcggtgaaatgcgtagagattaggaagaacaccagtggcgaaggcgattctctggactgtaactgacgctgaggcacgaaagcgtgggtagcaaacaggattagataccctggtagtccacgccgtaaacgatgaatactaggtgtaggaggtatcgaccccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctggacttgacatcccctgaataacctagagataggcgaagcccttcggggcagggagacaggtggtgcatggttgtcgtcagctcgtgtcgtgagatgttaggttaagtcctgcaacgagcgcaacccttatcattagttgctaccattaagttgagcactctagtgagactgcccgggttaaccgggaggaaggtggggatgacgtcaaatcatcatgccccttatgtccagggcaacacacgtgctacaatggtgggtacagagagatgcaataccgcgaggttgagccaaactctaaaacccatcccagttcggattgtaggctgaaactcgcctacatgaagctggagttgctagtaatcgcgaatcataatgtcgcggtgaatacgttcccgggccttgtacacaccgcccgtcacaccatgagagctggtaacacccgaagtccgtgagataaccgtaaggagtcagcggccgaaggtgggattagtaattggggtgaagtcgtaacaaggtagccgtaggagaacctgcggctggatcacctcctttcta

SEQ ID NO: 534 - DNA, 1517 bp, Clostridium sp. JN500901
  ref <308>: DATABASE ACCESSION NUMBER: NCBI ACCESSION: NZ_CP032416.1
  ref <309>: DATABASE ENTRY DATE: 2019-04-01
  ref <313>: RELEVANT RESIDUES IN SEQ ID NO: (1)..(1517)
ttaaattgagagtttgatcctggctcaggacgaacgctggcggcgtgcttaacacatgcaagtcgagcgagagaaatcccttcggggatggatctagcggcggacgggtgagtaacacgtgggcaacctgcctcaaagagggggatagcctcccgaaagggagattaataccgcataatgttgttttactgcatagtaaagcaaccaaaggagtaatccactttgagatgggcccgcgtcgcattagttagttggtggggtaacggctcaccaaggcgacgatgcgtagccgacctgagagggtgatcggccacattggaactgagagacggtccagactcctacgggaggcagcagtggggaatattgcacaatgggcggaagcctgatgcagcaacgccgcgtgggtgatgaaggttttcggattgtaaagccctgtcttttgggacgataatgacggtaccagaggaggaagccacggctaactacgtgccagcagccgcggtaatacgtaggtggcgagcgttgtccggatttactgggcgtaaagggtgcgtaggcggatatttaagtgggatgtgaaaaccccgggcttaacccggggactgcatttcaaactggatatctggagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatgagtactaggtgtaggaggtatcgaccccttctgtgccgcagtaaacgcaataagtactccgcctgggaagtacgatcgcaagattaaaactcaaaggaattgacgggggcccgcacaagcagcggagcatgtggtttaattcgaagcaacgcgaagaaccttacctagacttgacatcccctgaattacctgtaattagggaagccctccggggcagggagacaggtggtgcatggttgtcgtcagctcgtgtcgtgagatgttaggttaagtcctgcaacgagcgcaacccctatcattagttgctaccattaagttgagcactctagtgagactgcccgggtcaaccgggaggaaggtggggatgacgtcaaatcatcatgccccttatgtctagggctacacacgtgctacaatggtgaatacagagagatgcaaacccgcaagggtgagccaaactttaaaattcacctcagttcggattgcaggctgaaacccgcctgcatgaagctggagttgctagtaatcgcgaatcagaatgtcgcggtgaatgcgttcccgggccttgtacacaccgcccgtcacaccatgagagttggcaacacccgaagtccgtggggtaaccgtaaggaaccagcggccgaaggtggggttaataattggggtgaagtcgtaacaaggtagccgtaggagaacctgcggctggatcacctcctttcta

SEQ ID NO: 535 - DNA, 1315 bp, Clostridium sp. LS
  ref <308>: DATABASE ACCESSION NUMBER: NCBI ACCESSION: NZ_AUUU01000246.1
  ref <309>: DATABASE ENTRY DATE: 2019-04-01
  ref <313>: RELEVANT RESIDUES IN SEQ ID NO: (1)..(1315)
attaaaggagcaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgccgtggttaacgcggaggaaggtggggatgacgtcaaatcatcatgccccttatgtctagggctacacacgtgctacaatggtcggtacagagagatgctaaaccgcgaggtggagccaaactttaaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcggggcagcgacctaaggtagggtcagcgattggggtgaagtcgtaacaaggtagccgtaggagaacctgcggctggatcacctcctttcta

SEQ ID NO: 536 - DNA, 1519 bp, Clostridium sp. MF28
  ref <308>: DATABASE ACCESSION NUMBER: NCBI ACCESSION: NZ_CP014331.1
  ref <309>: DATABASE ENTRY DATE: 2019-04-01
  ref <313>: RELEVANT RESIDUES IN SEQ ID NO: (1)..(1519)
ttttaattgagagtttgatcctggctcaggacgaacgctggcggcgtgcttaacacatgcaagtcgagcgagatgaactccttcgggagggactctagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgtgaggcggagctaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgcaagcggggcagcgacctaaggtagggtcagcgattggggtgaagtcgtaacaaggtagccgtaggagaacctgcggctggatcacctcctttcta

SEQ ID NO: 537 - DNA, 1516 bp, Clostridium sp. Marseille-P4200
  ref <308>: DATABASE ACCESSION NUMBER: NCBI ACCESSION: NZ_UYZZ01000020.1
  ref <309>: DATABASE ENTRY DATE: 2019-04-01
  ref <313>: RELEVANT RESIDUES IN SEQ ID NO: (1)..(1516)
tttaaattgagagtttgatcctggctcaggacgaacgctggcggcgtgcctaacacatgcaagtcgagcgatgaagctccttcgggagtggattagcggcggacgggtgagtaacacgtgggtaacctgcctcaaagtgggggatagccctccgaaaggaggattaataccgcataacattcagacctcgcatgaggaatgaatcaaaggagtaatccgctttgagatgggcccgcggtgcattagctagttggtaaggtaaaagcttaccaaggcgacgatgcatagccgacctgagagggtgatcggccacattggaactgagatacggtccagactcctacgggaggcagcagtggggaatattgcgcaatgggggaaaccctgacgcagcaacgccgcgtgggtgatgaaggtcttcggattgtaaaaccctgtcttctgggacgataatgacggtaccagaggaggaagccacggctaactacgtgccagcagccgcggtaatacgtaggtggcgagcgttgtccggatttactgggcgtaaagggtgcgtaggcggactcttaagtgggatgtgaaatacccgggcttaacccgggggctgcattccaaactgggagtctagagtgcaggagaggagaatggaattcctagtgtagcggtgaaatgcgtagagattaggaagaacaccagtggcgaaggcgattctctggactgtaactgacgctgaggcacgaaagcgtgggtagcaaacaggattagataccctggtagtccacgccgtaaactatgaatactaggtgtaggaggtatcgaccccttctgtgccgcagttaacacaataagtattccgcctggggagtacggtcgcaagattaaaactcaaaggaattgacgggggcccgcacaagcagcggagcatgtggtttaattcgaagcaacgcgaagaaccttacctagacttgacatcccctgaattactcgtaacggaggaagcccttcggggcagggagacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtgagtacagagagatgcaataccgcaaggtggagctaaactcaaaaactcatcccagttcggattgtaggctgaaactcgcctacatgaagccggagttgctagtaatcgcgaatcagcatgtcgcggtgaatacgttcccgggccttgtacacaccgcccgtcacaccatgagagttggcaacacccgaagtccgtgaggtaaccgtaaggagccagcggccgaaggtggggttgatgattggggtgaagtcgtaacaaggtagccgtaggagaacctgcggctggatcacctcctttcta

SEQ ID NO: 538 - DNA, 1514 bp, Clostridium sp. Marseille-P4344
  ref <308>: DATABASE ACCESSION NUMBER: NCBI ACCESSION: NZ_OKRA01000010.1
  ref <309>: DATABASE ENTRY DATE: 2019-04-01
  ref <313>: RELEVANT RESIDUES IN SEQ ID NO: (1)..(1514)
attgagagtttgatcctggctcaggacgaacgctggcggcgtgcctaacacatgcaagtcgagcgatgaagcttcttcggaagtggattagcggcggacgggtgagtaacacgtgggcaacctgcctcatagagagggatagcctttcgaaaggaagattaatacctcataagattgtagtttcgcatgaaacggcaataaaaggagtaatccgctatgagatgggcccgcgtcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggtcttcggattgtaaaactctgtctttggggacgataatgacggtacccaaggaggaagccacggctaactacgtgccagcagccgcggtaatacgtaggtggcaagcgttgtccggatttactgggcgtaaagggagcgtaggtggatatttaagtgggatgtgaaatactcgggcttaacctgagtgctgcattccaaactggatatctagagtgcaggagaggaaagtggaattcctagtgtagcggtgaaatgcgtagatattaggaagaacaccagtggcgaaggcgactttctggactgtaactgacactgaggctcgaaagcgtggggagcgaacaggattagataccctggtagtccacgccgtaaacgatgaatactaggtgtaggagctgtcatggcttctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagtcacttcggtgacaggaagacaggtggtgcatggttgtcgtcagctcgtgtcgtgagatgttgggttaagtcccgcaacgagcgcaacccttattgttagttgctaccatttagttgagcactctagcgagactgccgtggttaacgcggaggaaggtggggatgacgtcaaatcatcatgccccttatgtctagggctacacacgtgctacaatggctggtacaaagagatgcaataccgcgaggtggagctaaactataaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcgacctaaggtagggtcagcgattggggtgaagtcgtaacaaggtagccgtaggagaacctgcggctggatcacctcctttcta

SEQ ID NO: 539 - DNA, 1542 bp, Clostridium sp. Marseille-P8228
  ref <308>: DATABASE ACCESSION NUMBER: NCBI ACCESSION: NZ_UYZY01000006.1
  ref <309>: DATABASE ENTRY DATE: 2019-04-01
  ref <313>: RELEVANT RESIDUES IN SEQ ID NO: (1)..(1542)
ttaaacatgagagtttgatcctggctcaggatgaacgctggcggcgtgcctaacacatgcaagtcgaacgaagcgatttagcggaagttttcggatggaagctaagttgactgagtggcggacgggtgagtaacgcgtgggtaacctgccttgtactgggggacaacagttagaaatgactgctaataccgcataagcgcacagcatcacatgatgcggtgtgaaaaactccggtggtacaagatggacccgcgtctgattagctagttggtagggtaacggcctaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtactgtaagtctgaagtgaaagcccgcggctcaactgcgggactgctttggaaactatggaactagagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagctaccctggtcgtccacgccgtcaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgaccggggagtaacgtccccttcccttcggggcggagaagacaggtggtgcatggttgtcgtcagctcgtgtcgtgagatgttgggttaagtcccgcaacgagcgcaacccttatcctaagtagccagcacgtagaggtgggaactcttgggagactgccagggataacctggaggaaggtggggatgacgtcaaatcatcatgccccttatgatctgggctacacacgtgctacaatggcgtaaacaaagagaagcgagaccgcgaggtggagcaaatctcagaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 540 - DNA, 1511 bp, Clostridium sp. NJ4; identical to SEQ ID NO: 431
  ref <308>: DATABASE ACCESSION NUMBER: NCBI ACCESSION: NZ_PYBN01000004.1
  ref <309>: DATABASE ENTRY DATE: 2019-04-01
  ref <313>: RELEVANT RESIDUES IN SEQ ID NO: (1)..(1511)

SEQ ID NO: 541 - DNA, 1000 bp, Clostridium sp. OF09-10
  ref <308>: DATABASE ACCESSION NUMBER: NCBI ACCESSION: NZ_QUMH01000069.1
  ref <309>: DATABASE ENTRY DATE: 2019-04-01
  ref <313>: RELEVANT RESIDUES IN SEQ ID NO: (1)..(1000)
tttaacatgagagtttgatcctggctcaggatgaacgctggcggcgtgcctaacacatgcaagtcgaacgaggtaaatgagatgaagttttcggatggattcttatttaccgagtggcggacgggtgagtaacgcgtgggtaacctgcctcatacagggggataacgattggaaacgattgctaataccgcataagcgcacagtaccacatggtacggtgtgaaaaactccggtggtatgagatggacccgcgtctgattagctagttggtgaggtaacggcccaccaagcaacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaatacccgggctcaacctgggaactgctttggaaactgtatggctagagtgctggagaggtaagcggaattcctagtgtagcggtgaaatgcgtagatattaggaagaacaccagtggcgaaggcggcttactggacagtaactgacgttcaggctcgaaagcgtggggagcaaacaggattagataccctggtagtccacgccgtaaacgatgaatactaggtgtcgggggacaaagtctttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaacact

SEQ ID NO: 542 - DNA, 1530 bp, Clostridium sp. OF09-36
  ref <308>: DATABASE ACCESSION NUMBER: NCBI ACCESSION: NZ_QUMD01000078.1
  ref <309>: DATABASE ENTRY DATE: 2019-04-01
  ref <313>: RELEVANT RESIDUES IN SEQ ID NO: (1)..(1530)
tttatttgagagtttgatcctggctcaggatgaacgctggcggcgtgcttaacacatgcaagtcgagcgaagcacttatgaaagattcttcggatgatttcatttgtgactgagcggcggacgggtgagtaacgcgtgggtaacctgcctcatacagggggataacagttggaaacgactgctaataccgcataagcgcacagtaccgcatggtacagtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgagacaagtctgaagtgaaagcccggggctcaaccccgggactgctttggaaactgccttgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatcccgatgaaaagtccttaaccggactccctcttcggagcatcggtgacaggtggtgcatggttgtcgtcagctcgtgtcgtgagatgttgggttaagtcccgcaacgagcgcaacccttatccttagtagccagcagtaagatgggcactctagggagactgccagggataacctggaggaaggtggggatgacgtcaaatcatcatgccccttatgatttgggctacacacgtgctacaatggcgtaaacaaagagaagcgagcctgcgagggggagcaaatctcaaaaataacgtctcagttcggattgcaggctgcaactcgcctgcatgaagctggaatcgctagtaatcgcggatcagaatgccgcggtgaatacgttcccgggtcttgtacacaccgcccgtcacaccatgggagtcgataacgcccgaagtcagtgacccaaccgcaaggagggagctgccgaaggcgggattgataactggggtgaagtcgtaacaaggtagccgtatcggaaggtgcggctggatcacctcctt

SEQ ID NO: 543 - DNA, 1526 bp, Clostridium sp. OF10-22XD
  ref <308>: DATABASE ACCESSION NUMBER: NCBI ACCESSION: NZ_QUMB01000025.1
  ref <309>: DATABASE ENTRY DATE: 2019-04-01
  ref <313>: RELEVANT RESIDUES IN SEQ ID NO: (1)..(1526)
tttaatgagagtttgatcctggctcaggatgaacgctggcggcgtgcttaacacatgcaagtcgaacgagagaagatcggtgcttgcactgatccgatcgagtggcggacgggtgagtaacgcgtgggtaacctgcctcatacaggggaataacagttggaaacggctgctaaaaccgcataagcgcacagtatcgcatgatacagtgtgaaaaactccggtggtatgagatggacccgcgtctgattagctagttggtgaggtaacggcccaccaagcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagccaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaaccggaactttccttcgggacagcagagacaggtggtgcatggttgtcgtcagctcgtgtcgtgagatgttgggttaagtcccgcaacgagcgcaacccctatttccagtagccagcagttagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 544 - DNA, 1540 bp, Clostridium sp. OF13-4
  ref <308>: DATABASE ACCESSION NUMBER: NCBI ACCESSION: NZ_QULZ01000044.1
  ref <309>: DATABASE ENTRY DATE: 2019-04-01
  ref <313>: RELEVANT RESIDUES IN SEQ ID NO: (1)..(1540)
tttaacatgagagtttgatcctggctcaggatgaacgctggcggcgtgcttaacacatgcaagtcgaacgaagcgatttggcggaaattttcggatggaagctagattgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctagttggtggggtaacggcctaccaagcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgtaaggagggagctgccgaaggcaggaccgataactggggtgaagtcgtaacaaggtagccgtatcggaaggtgcggctggatcacctcctttctaaggaa

SEQ ID NO: 545 - DNA, 1216 bp, Clostridium sp. OM02-18AC
  ref <308>: DATABASE ACCESSION NUMBER: NCBI ACCESSION: NZ_QULW01000043.1
  ref <309>: DATABASE ENTRY DATE: 2019-04-01
  ref <313>: RELEVANT RESIDUES IN SEQ ID NO: (1)..(1216)
cggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgagacaagtctgaagtgaaagcccggggctcaaccccgggactgctttggaaactgccttgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatcccgatgaaaagtccttaaccggactccctcttcggagcatcggtgacaggtggtgcatggttgtcgtcagctcgtgtcgtgagatgttgggttaagtcccgcaacgagcgcaacccttatccttagtagccagcagtaagatgggcactctggggagactgccagggataacctggaggaaggtggggatgacgtcaaatcatcatgccccttatgatttgggctacacacgtgctacaatggcgtaaacaaagagaagcgagcccgcgagggggagcaaatctcaaaaataacgtctcagttcggattgcaggctgcaactcgcctgcatgaagctggaatcgctagtaatcgcggatcagaatgccgcggtgaatacgttcccgggtcttgtacacaccgcccgtcacaccatgggagtcgataacgcccgaagtcagtgacccaaccgcaaggagggagctgccgaaggcgggattgataactggggtgaagtcgtaacaaggtagccgtatcggaaggtgcggctggatcacctcctttctaagga

SEQ ID NO: 546 - DNA, 1433 bp, Clostridium sp. OM04-12AA
  ref <308>: DATABASE ACCESSION NUMBER: NCBI ACCESSION: NZ_QULR01000098.1
  ref <309>: DATABASE ENTRY DATE: 2019-04-01
  ref <313>: RELEVANT RESIDUES IN SEQ ID NO: (1)..(1433)
tttaacatgagagtttgatcctggctcaggatgaacgctggcggcgtgcttaacacatgcaagtcgagcgaagcaatttaagtgaagttttcggatggatcttaaattgactgagcggcggacgggtgagtaacgcgtggataacctgcctcacacagggggataacagttagaaatgactgctaataccgcataagcgcacggtaccgcatggtacagtgtgaaaaactccggtggtgtgagatggatccgcgtctgattaggtagttggtgaggtaacggcccaccaagccgacgatcagtagccgacctgagagggtgaccggccacattgggactgagacacggcccaaactcctacgggaggcagcagtggggaatattgcacaatgggcgaaagcctgatgcagcaacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcactgcaagtctgaagtgaaagcccggggctcaaccccgggactgctttggaaactgtagagctagagtgctggagaggcaagcggaattcctagtgtagcggtgaaatgcgtagatattaggaagaacaccagtggcgaaggcggcttgctggacagtaactgacgttcaggctcgaaagcgtggggagcaaacaggattagataccctggtagtccacgccgtaaacgatgaatactaggtgttggtgggcaaagcccatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgtgatgaccggaacttaaccgttccttcccttcggggcatcatagacaggtggtgcatggttgtcgtcagctcgtgtcgtgagatgttgggttaagtcccgcaacgagcgcaacccttatcctcagtagccagcagtaagatgggcactctggggagactgccagggataacctggaggaaggtggggatgacgtcaaatcatcatgccccttatgatttgggctacacacgtgctacaatggcgtaaacaaagggaagcgatagggtgacctggagcaaatcccaaaaataacgtcccagttcggactgtagtctgcaacccgactacacgaagctggaatcgctagtaatcgcagatcagaatgctgcggtgaatacgttcccgggtcttgtacacaccgcccgtcacaccatgggagtcagcaacgcccgaagtcagtgac

SEQ ID NO: 547 - DNA, 1436 bp, Clostridium sp. OM04-7
  ref <308>: DATABASE ACCESSION NUMBER: NCBI ACCESSION: NZ_QULL01000026.1
  ref <309>: DATABASE ENTRY DATE: 2019-04-01
  ref <313>: RELEVANT RESIDUES IN SEQ ID NO: (1)..(1436)
attgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaggcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgcaaggagggagctgccgaaggcaggaccgataactggggtgaagtcgtaacaaggtagccgtatcggaaggtgcggctggatcacctcctttctaaggaa

SEQ ID NO: 548 - DNA, 1541 bp, Clostridium sp. OM05-5BH
  ref <308>: DATABASE ACCESSION NUMBER: NCBI ACCESSION: NZ_QULJ01000001.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcaatttagcggaagttttcggatggaagctagattgactgagtggcggacgggtgagtaacgcgtgggtaacctgcctcacactgggggacaacagttagaaatgactgctaataccgcataagcgcacaggaccgcatggtctggtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgaaaggagggagctgccgaaggcaggaccgataactggggtgaagtcgtaacaaggtagccgtatcggaaggtgcggctggatcacctcctttctaaggaa

SEQ ID NO: 549 - DNA, 1540 bp, Clostridium sp. OM05-6BH
  ref <308>: DATABASE ACCESSION NUMBER: NCBI ACCESSION: NZ_QULH01000043.1
  ref <309>: DATABASE ENTRY DATE: 2019-04-01
  ref <313>: RELEVANT RESIDUES IN SEQ ID NO: (1)..(1540)
ttaaacatgagagtttgatcctggctcaggatgaacgctggcggcgtgcctaacacatgcaagttgaacgaagacataccgacggaatccttcgggaggaagatggtatggactgagtggcggacgggtgagtaacgcgtgggtaacctgccctgtacagggggacaacagttagaaatgactgctaataccgcataagcgcacggtaccgcatggtacagtgcgaaaaactccggtggtacaggatgggcccgcgtctgattagttagttggcggggtaacggcccaccaagacgacgatcagtagccggcttgagagagtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcaggcggtgcggcaagtcagatgtgaaaacccggggctcaaccccgggactgcatttgaaactgtcggactagagtgccggagaggtaagtggaattcctagtgtagcggtgaaatgcgtagatattaggaggaacaccagtggcgaaggcggcttactggacggtaactgacgctgaggctcgaaagcgtggggagcaaacaggattagataccctggtagtccacgccgtaaacgatgaatactaggtgtcggggcacataagtgcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccagtccttgacatccaactgaccgaccagtaacgtggtcttctcttcggagcagttgagacaggtggtgcatggttgtcgtcagctcgtgtcgtgagatgttgggttaagtcccgcaacgagcgcaacccctatccttagtagccagcagtaagatgggaactctagggagactgccggggataacccggaggaaggtggggacgacgtcaaatcatcatgccccttatgggctgggctacacacgtgctacaatggtgctaacagagtgaggcgagactgtgaagttaagcaaatcacaaaaatggcatctcagttcggattgtagtctgcaactcgactacatgaagctggaatcgctagtaatcgcagatcagaatgctgcggtgaatacgttcccgggtcttgtacacaccgcccgtcacaccatgggagttgggaatgcccgaagccggtgacctaaccgtaaggaaggagccgtcgaaggcaggctcgataactggggtgaagtcgtaacaaggtagccgtatcggaaggtgcggctggatcacctcctttctaag

SEQ ID NO: 550 - DNA, 1527 bp, Clostridium sp. OM05-9; identical to SEQ ID NO: 515
  ref <308>: DATABASE ACCESSION NUMBER: NCBI ACCESSION: NZ_QULF01000006.1
  ref <309>: DATABASE ENTRY DATE: 2019-04-01
  ref <313>: RELEVANT RESIDUES IN SEQ ID NO: (1)..(1527)

SEQ ID NO: 551 - DNA, 1540 bp, Clostridium sp. OM07-10AC
  ref <308>: DATABASE ACCESSION NUMBER: NCBI ACCESSION: NZ_QULC01000061.1
  ref <309>: DATABASE ENTRY DATE: 2019-04-01
  ref <313>: RELEVANT RESIDUES IN SEQ ID NO: (1)..(1540)
ttaaacatgagagtttgatcctggctcaggatgaacgctggcggcgtgcctaacacatgcaagtcgaacgaagctcttacgacagaactcttcggagggaagatgtaagagactgagtggcggacgggtgagtaacgcgtgggtaacctgccctatacagggggacaacagttggaaacgactgctaataccgcataagcgcacagtaccgcatggtacagagcgaaaaactccggtggtataggatgggcccgcgtctgattagctagttggaggtgtaacggaccaccaaggcgacgatcagtagccggcttgagagagtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcaggcggtctggcaagtctgatgtgaaatcccggggctcaaccctggaactgcattggaaactgtcagactagagtgccggagaggtaagtggaattcctagtgtagcggtgaaatgcgtagatattaggaggaacaccagtggcgaaggcggcttactggacggtaactgacgctgaggctcgaaagcgtggggagcaaacaggattagataccctggtagtccacgccgtaaacgatgaatactaggtgtcggggcacaaaagtgcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggccttgacatcctgctgaccgttccttaaccggaacctctcttcggagcagcagagacaggtggtgcatggttgtcgtcagctcgtgtcgtgagatgttgggttaagtcccgcaacgagcgcaacccctatcctcagtagccagcagttcggctgggcactctgtggagactgccggggataacccggaggaaggtggggatgacgtcaaatcatcatgccccttatggcctgggctacacacgtgctacaatggtgctaacagagagaagcgaaactgtgaagtggagcaaagctcaaaaatggcatctcagttcggattgtagtctgcaactcgactacatgaagctggaatcgctagtaatcgcagacagaatgctgcggtgaatacgttcccgggtcttgtacacaccgcccgtcacaccatgggagttgggaatgcccgaagtcagtgacccaaccgtaaggagggagctgccgaaggcaggctcgataactggggtgaagtcgtaacaaggtagccgtatcggaaggtgcggctggatcacctcctttctaag

SEQ ID NO: 552 - DNA, 1541 bp, Clostridium sp. OM07-9AC
  ref <308>: DATABASE ACCESSION NUMBER: NCBI ACCESSION: NZ_QUKY01000050.1
  ref <309>: DATABASE ENTRY DATE: 2019-04-01
  ref <313>: RELEVANT RESIDUES IN SEQ ID NO: (1)..(1541)
ttaaacatgagagtttgatcctggctcaggatgaacgctggcggcgtgcctaacacatgcaagtcgaacgaagctcttacgacagaactcttcggagggaagatgtaagagactgagtggcggacgggtgagtaacgcgtgggtaacctgccctatacagggggacaacagttggaaacgactgctaataccgcataagcgcacagtaccgcatggtacagagcgaaaaactccggtggtataggatgggcccgcgtctgattagctagttggaggtgtaacggaccaccaaggcgacgatcagtagccggcttgagagagtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcaggcggtctggcaagtctgatgtgaaatcccggggctcaaccctggaactgcattggaaactgtcagactagagtgccggagaggtaagtggaattcctagtgtagcggtgaaatgcgtagatattaggaggaacaccagtggcgaaggcggcttactggacggtaactgacgctgaggctcgaaagcgtggggagcaaacaggattagataccctggtagtccacgccgtaaacgatgaatactaggtgtcggggcacaaaagtgcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggccttgacatcctgctgaccgttccttaaccggaacctctcttcggagcagcagagacaggtggtgcatggttgtcgtcagctcgtgtcgtgagatgttgggttaagtcccgcaacgagcgcaacccctatcctcagtagccagcagttcggctgggcactctgtggagactgccggggataacccggaggaaggtggggatgacgtcaaatcatcatgccccttatggcctgggctacacacgtgctacaatggtgctaacagagagaagcgaaactgtgaagtggagcaaagctcaaaaatggcatctcagttcggattgtagtctgcaactcgactacatgaagctggaatcgctagtaatcgcagatcagaatgctgcggtgaatacgttcccgggtcttgtacacaccgcccgtcacaccatgggagttgggaatgcccgaagtcagtgacccaaccgtaaggagggagctgccgaaggcaggctcgataactggggtgaagtcgtaacaaggtagccgtatcggaaggtgcggctggatcacctcctttctaag

SEQ ID NO: 553 - DNA, 1530 bp, Clostridium sp. OM08-29
  ref <308>: DATABASE ACCESSION NUMBER: NCBI ACCESSION: NZ_QUKW01000004.1
  ref <309>: DATABASE ENTRY DATE: 2019-04-01
  ref <313>: RELEVANT RESIDUES IN SEQ ID NO: (1)..(1530)
tttttatgagagtttgatcctggctcaggatgaacgctggcggcgtgcttaacacatgcaagtcgaacgaagacatctgagtgcttgcacttggatggactgagtggcggacgggtgagtaacgcgtgggtaacctgccttatacagggggataacagttggaaacgactgctaataccgcataagcgcacggtatcgcatgatacagtgtgaaaaactccggtggtataagatggacccgcgtctgattagcttgttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaaactctatcagcagggaagataatgacggtacctgactaagaagcaccggctaaatacgtgccagcagccgcggtaatacgtatggtgcaagcgttatccggatttactgggtgtaaagggtgcgtaggtggtatggcaagtcagaagtgaaaggctggggctcaaccccgggactgcttttgaaactgtcaaactagagtacaggagaggaaagcggaattcctagtgtagcggtgaaatgcgtagatattaggaggaacaccagtggcgaaggcggctttctggactgaaactgacactgaggcacgaaagcgtggggagcaaacaggattagataccctggtagtccacgccgtaaacgatgaatactaggtgtcgggcagcatagctgttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggtcttgacatcccgatgaccgcttcttaatcgaagcttttcttcggaacatcggagacaggtggtgcatggttgtcgtcagctcgtgtcgtgagatgttgggttaagtcccgcaacgagcgcaacccctattttcagtagccagcattttggatgggcactctggagagactgcccgggataaccgggaggaaggtggggatgacgtcaaatcatcatgccccttatgatctgggctacacacgtgctacaatggctgttacagagagaagcgaatccgcgaggaagagcaaacctcaaaaaggcagtctcagttcggattgtagtctgcaactcgactacatgaagctggaatcgctagtaatcgcgaatcagaatgtcgcggtgaatacgttcccgggtcttgtacacaccgcccgtcacaccatgggagttggaaatgcccgaagtcagtgacccaaccgcaaggagggagctgccgaaggcaggttcgatgactggggtgaagtcgtaacaaggtagccgtatcggaaggtgcggctggatcacctcctttctaaggaa

SEQ ID NO: 554 - DNA, 1540 bp, Clostridium sp. PI-S10-A1B
  ref <308>: DATABASE ACCESSION NUMBER: NCBI ACCESSION: NZ_QOHO01000069.1
  ref <309>: DATABASE ENTRY DATE: 2019-04-01
  ref <313>: RELEVANT RESIDUES IN SEQ ID NO: (1)..(1540)
ttaatttgagagttcgatcctggctcaggatgaacgctggcggcgtgcttaacacatgcaagtcgagcgaagcagttttaaggaagttttcggatggaattaaaattgactgagcggcggacgggtgagtaacgcgtgggtaacctgcctcatacagggggataacagttggaaacgactgctaataccgcataagcgcacagtgctgcatggcacggtgtgaaaaactccggtggtatgagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgactgaagaagtatttcggtatgtaaaggtctatcagcagggaagaaaatgacggtacctgactaagaagccccggctaactacgtgccagcagccgcggtaatacgtagggggcaagcgttatccggatttactgggtgtaaagggagcgtagacggcgatgcaagtctggagtgaaagcccggggctcaaccccgggactgctttggaaactgtgttgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcagtttggctgggcactctggggagactgccagggataacctggaggaaggtggggatgacgtcaaatcatcatgccccttatgatttgggctacacacgtgctacaatggcgtaaacaaagggaagcgaaggagtgatccggagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 555 - DNA, 1539 bp, Clostridium sp. SN20
  ref <308>: DATABASE ACCESSION NUMBER: NCBI ACCESSION: NZ_LT962674.1
  ref <309>: DATABASE ENTRY DATE: 2019-04-01
  ref <313>: RELEVANT RESIDUES IN SEQ ID NO: (1)..(1539)
tttattgagagtttgatcctggctcaggatgaacgctggcggcgtgcttaacacatgcaagtcgaacggagtgctcatgacggagttttcggacaacggattgggttacttagtggcggacgggtgagtaacgcgtgaggaacctgcctcggagtggggaataacataccgaaaggtgtgctaataccgcataatgcagttgggtcgcatgactctgactgccaaagatttatcgctctgagatggcctcgcgtctgattagctagttggcggggtaacggcccaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcagggacgaaacaaatgacggtacctgacgaataagccacggctaactacgtgccagcagccgcggtaatacgtaggtggcaagcgttatccggatttactgggtgtaaagggcgtgtaggcgggactgcaagtcaggtgtgaaaaccaggggctcaacctctggcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggactgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcctactaacgaagcagagatgcattaggtgcccttcggggaaagtagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggtggttaacagagggaagcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaaggtgcggctggatcacctcctttctaagga

SEQ ID NO: 556 - DNA, 1541 bp, Clostridium sp. TF01-11
  ref <308>: DATABASE ACCESSION NUMBER: NCBI ACCESSION: NZ_QUKT01000001.1
  ref <309>: DATABASE ENTRY DATE: 2019-04-01
  ref <313>: RELEVANT RESIDUES IN SEQ ID NO: (1)..(1541)
ttaaacatgagagtttgatcctggctcaggatgaacgctggcggcgtgcctaacacatgcaagtcgaacgaagctcctgcgacagattccttcgggatgaagatgcttgagacttagtggcggacgggtgagtaacgcgtgggtaacctgccctgtactgggggacaacagttagaaatgactgctaataccgcataagcctacggagtcgcatgactcagcaggaaaaattccggtggtacaggatgggcccgcgtctgattagctagttggtgaggtaatggctcaccaaggcgacgatcagtagccggcttgagagagtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgcaggcggtctggcaagtctgatgtgaaaatccggggctcaactccggaactgcattggaaactgtcagactagagtgtcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggcacaaaagtgcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccagtccttgacatcccgatgaccgacctgtaacgaggtcttctcttcggagcatcggagacaggtggtgcatggttgtcgtcagctcgtgtcgtgagatgttgggttaagtcccgcaacgagcgcaacccctgtccttagtagccagcagttcggctgggcactctagggagactgccggggataacccggaggaaggtggggacgacgtcaaatcatcatgccccttatgggctgggctacacacgtgctacaatggtgctaacaaagtgaagcaagctggtgacagtaagcaaatcacaaaaatggcatctcagttcggattgtagtctgcaactcgactacatgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggtctgataactggggtgaagtcgtaacaaggtagccgtatcggaaggtgcggctggatcacctcctttctaag

SEQ ID NO: 557 - DNA, 1541 bp, Clostridium sp. TF06-15AC
  ref <308>: DATABASE ACCESSION NUMBER: NCBI ACCESSION: NZ_QUKS01000002.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcaatctaacggaagttttcggatggaagctggattgactgagtggcggacgggtgagtaacgcgtgggtaacctgcctcacactgggggacaacagttagaaatgactgctaataccgcataagcgcacaggaccgcatggtccggtgtgaaaaactccggtggtgtgagatggacccgcgtttgattagctggttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaggcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgcaaggagggagctgccgaaggcaggaccgataactggggtgaagtcgtaacaaggtagccgtatcggaaggtgcggctggatcacctcctttctaaggaa

SEQ ID NO: 558 - DNA, 1437 bp, Clostridium sp. TF11-13AC
  ref <308>: DATABASE ACCESSION NUMBER: NCBI ACCESSION: NZ_QUKJ01000017.1
  ref <309>: DATABASE ENTRY DATE: 2019-04-01
  ref <313>: RELEVANT RESIDUES IN SEQ ID NO: (1)..(1437)
gattgactgagtggcggacgggtgagtaacgcgtgggtaacctgcctcacactgggggacaacagttagaaatgactgctaataccgcataagcgcacaggaccgcatggtctggtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggtgagtaacgtcacctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaagcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgtaaggagggagctgccgaaggcaggaccgataactggggtgaagtcgtaacaaggtagccgtatcggaaggtgcggctggatcacctcctttctaaggaa

SEQ ID NO: 559 - DNA, 1540 bp, Clostridium sp. TM06-18
  ref <308>: DATABASE ACCESSION NUMBER: NCBI ACCESSION: NZ_QUKE01000021.1
  ref <309>: DATABASE ENTRY DATE: 2019-04-01
  ref <313>: RELEVANT RESIDUES IN SEQ ID NO: (1)..(1540)
tttaacatgagagtttgatcctggctcaggatgaacgctggcggcgtgcttaacacatgcaagtcgagcgaagcaatttaagtgaagttttcggatggatcttaaattgactgagcggcggacgggtgagtaacgcgtggataacctgcctcacacagggggataacagttagaaatgactgctaataccgcataagcgcacggtaccgcatggtacagtgtgaaaaactccggtggtgtgagatggatccgcgtctgattaggtagttggtgaggtaacggcccaccaagccgacgatcagtagccgacctgagagggtgaccggccacattgggactgagacacggcccaaactcctacgggaggcagcagtggggaatattgcacaatgggcgaaagcctgatgcagcaacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcactgcaagtctgaagtgaaagcccggggctcaaccccgggactgctttggaaactgtagagctagagtgctggagaggcaagcggaattcctagtgtagcggtgaaatgcgtagatattaggaagaacaccagtggcgaaggcggcttgctggacagtaactgacgttcaggctcgaaagcgtggggagcaaacaggattagataccctggtagtccacgccgtaaacgatgaatactaggtgttggtgggcaaagcccatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgtgatgaccggaacttaaccgttccttcccttcggggcatcatagacaggtggtgcatggttgtcgtcagctcgtgtcgtgagatgttgggttaagtcccgcaacgagcgcaacccttatcctcagtagccagcagtaagatgggcactctggggagactgccagggataacctggaggaaggtggggatgacgtcaaatcatcatgccccttatgatttgggctacacacgtgctacaatggcgtaaacaaagggaagcgagagggtgacctggagcaaatcccaaaaataacgtcccagttcggactgtagtctgcaacccgactacacgaagctggaatcgctagtaatcgcagatcagaatgctgcggtgaatacgttcccgggtcttgtacacaccgcccgtcacaccatgggagtcagcaacgcccgaagtcagtgactcaaccgcaaggagagagctgccgaaggcggggcaggtaactggggtgaagtcgtaacaaggtagccgtatcggaaggtgcggctggatcacctcctttctaaggaa

SEQ ID NO: 560 - DNA, 1548 bp, Clostridium sp. YH-panp20
  ref <308>: DATABASE ACCESSION NUMBER: NCBI ACCESSION: NZ_RJQC01000001.1
  ref <309>: DATABASE ENTRY DATE: 2019-04-01
  ref <313>: RELEVANT RESIDUES IN SEQ ID NO: (1)..(1548)
caaatgaagagtttgatcctggctcaggatgaacgctggcggcatgcctaatacatgcaagtcgaacggagaaggaaggtgcttgcatcttccggatcagtggcgaacgggtgagtaacacgtaggtaacctgcccatgtacccgggacaacggttggaaacgactgctaaaaccggataggcatatggaaggcatcttcgatatgttaaaggggccacggccctggacatggatggacctgcggtgcattagccagttggtgaggtaacggcccaccaaggcgacgatgcatagccgacctgagagggcgaacggccacattgggactgagacacggcccaaactcctacgggaggcagcagtagggaattttcgtcaatggggggaaccctgaacgagcaatgccgcgtgagtgaagacggtcttcggattgtaaagctctgttgcgagagaaaaaggacaggaagagggaatgcttccggtttgatggtatctcgccagaaagtcacggctaactacgtgccagcagccgcggtaatacgtaggtggcgagcgttatccggaatgattgggcgtaaagggtacgtaggcggccagataagtctggtgtgaaaggctgcagctcaactgcagcactgcactggaaactgtccggctggagtgcagaagagggcgatggaactccatgtgtagcggtaaaatgcgtagatatatggaagaacaccggtggcgaaggcggtcgcctggtctgcaactgacgctgaagtacgaaagcgtggggagcaaataggattagataccctagtagtccacgccgtaaacgatgagaactaggtgttgggggaataactcagtgccgcagtcaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatcccctgcaaagatgcagagatgtatcggaggctatcagggagacaggtggtgcatggttgtcgtcagctcgtgtcgtgagatgttgggttaagtcccgcaacgagcgcaacccttgtgatatgttaccagtatcaagttagggactcatatcagactgccggtgacaaaccggaggaaggtggggatgacgtcaaatcatcatgccccttatggcctgggccacacacgtactacaatggcggatacagagggcagcgacagggcgacctggagcgaatcccgaaaagtccgtcccagttcggattggagtctgcaacccgactccatgaagttggaatcgctagtaatcgcgaatcagcatgtcgcggtgaatacgttctcgggccttgtacacaccgcccgtcaaaccatgggagtcagtaatacccgaagccggtggcataaccttagggagtgagccgtcgaaggtaggaccgatgactggggttaagtcgtaacaaggtatccctacgggaacgtggggatggatcacctcctttctaaggaga

SEQ ID NO: 561 - DNA, 788 bp, Clostridium sp. chh4-2
  ref <308>: DATABASE ACCESSION NUMBER: NCBI ACCESSION: NZ_PKUU01000053.1
  ref <309>: DATABASE ENTRY DATE: 2019-04-01
  ref <313>: RELEVANT RESIDUES IN SEQ ID NO: (1)..(788)
tgactaagaagccccggctaactacgtgccagcagccgcggtaatacgtagggggcaagcgttatccggatttactgggtgtaaagggagcgtagacggcatgacaagtctgaagtgaaagcccggggctcaaccccgggactgctttggaaactgccaggctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatcccactgaccggtctttaacaggaccttcccttcggggcagtggagacaggtggtgcatggttgtcgtcagctcgtgtcgtgagatgttgggttaagtcccgcaacgagcgcaacccttatccttagtagccagcatttcgggtgggcactctagggagactgccagggataacctggaggaaggtggggatgacgtcaaatcatcatgccccttatgatttgggctacacacgtgctacaatggcgtaaacaaagagaagcgagcccgcgagggggagc

SEQ ID NO: 562 - DNA, 1145 bp, Clostridium sp. link-BC1
  ref <308>: DATABASE ACCESSION NUMBER: NCBI ACCESSION: NZ_LSMZ01000156.1
  ref <309>: DATABASE ENTRY DATE: 2019-04-01
  ref <313>: RELEVANT RESIDUES IN SEQ ID NO: (1)..(1145)
tatcattgtatggcatcatacgatgatcaaaggagcaatccggtatgagatgggcccgcgtccgattagctagttggtgaggtaaaggctcaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggaagaaggccttcgggttgtaaacttctttgattggggacgaagaaagtgactgtacccaaaaaacaagccacggctaactacgtgccagcagccgcggtaatacgtaggtggcaagcgttgtccggaattactgggtgtaaagggcgtgtaggcgggtgaccaagtcagatgtgaaattccggggcttaactccggcgctgcatctgaaactggacatcttgagtgctggagaggaaagcggaattcctagtgtagcggtgaaatgcgtagatattaggaggaacaccagtggcgaaggcggctttctggacagtaactgacgctgaggcgcgaaagcgtggggagcaaacaggattagatacctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatcccttgacgatcctagagataggatttctcttcggagcaaggagacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctgttacagagggaagctaagccgcgaggtggagcaaacccccaaaggcagccccagttcagacttgcaggctgaaactcgcctgcatgaagtcggaattgctagt

SEQ ID NO: 563 - DNA, 1540 bp, Clostridium sporogenes
  ref <308>: DATABASE ACCESSION NUMBER: NCBI ACCESSION: NZ_UAWJ01000008.1
  ref <309>: DATABASE ENTRY DATE: 2019-04-01
  ref <313>: RELEVANT RESIDUES IN SEQ ID NO: (1)..(1540)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttccgggtcttgtacacaaccgcccgtcacaccatgggagtggggttttaccagaagtggctagtctaaaccgcaaggaggacggtcacacggtaggattcatgactggggtgaagtcgtaacaaggtagccgtatcggaaggtgcggctggatcacctcctttccag

SEQ ID NO: 564 - DNA, 1514 bp, Clostridium taeniosporum
  ref <308>: DATABASE ACCESSION NUMBER: NCBI ACCESSION: NZ_CP017253.2
  ref <309>: DATABASE ENTRY DATE: 2019-04-01
  ref <313>: RELEVANT RESIDUES IN SEQ ID NO: (1)..(1514)
attgagagtttgatcctggctcaggacgaacgctggcggcgtgcctaacacatgcaagtcgagcgatgaagctccttcgggagtggattagcggcggacgggtgagtaacacgtgggcaacctgcctcatagagagggatagccttccgaaaggaagattaatacctcataagattgtagtttcgcatgaaacagcaataaaaggagtaatccgctatgagatgggcccgcgtcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaaactctgtctttggggacgataatgacggtacccaaggaggaagccacggctaactacgtgccagcagccgcggtaatacgtaggtggcaagcgttgtccggatttactgggcgtaaagggagcgtaggtggatatttaagtgggatgtgaaatactcgggcttaacctgagtgctgcattccaaactggatatctagagtgcaggagaggaaagcggaattcctagtgtagcggtgaaatgcgtagatattaggaagaacaccagtggcgaaggcggctttctggactgtaactgacactgaggctcgaaagcgtggggagcgaacaggattagataccctggtagtctacgccgtaaacgatgaatactaggtgtaggagctgtcatggcttctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagtcgcttcggcgacaggaagacaggtggtgcatggttgtcgtcagctcgtgtcgtgagatgttgggttaagtcccgcaacgagcgcaacccttattgttagttgctaccatttagttgagcactctagcgagactgccgtggttaacgcggaggaaggtggggatgacgtcaaatcatcatgccccttatgtctagggctacacacgtgctacaatggctggtacagagagacgcaataccgtgaggtggagctaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtaagctaacccgtaagggaggcagcgacctaaggtagggtcagcgattggggtgaagtcgtaacaaggtagccgtaggagaacctgcggctggatcacctcctttcta

SEQ ID NO: 565 - DNA, 1300 bp, Clostridium tagluense
  ref <308>: DATABASE ACCESSION NUMBER: NCBI ACCESSION: NZ_BHYK01000104.1
  ref <309>: DATABASE ENTRY DATE: 2019-04-01
  ref <313>: RELEVANT RESIDUES IN SEQ ID NO: (1)..(1300)
attccactttgagatggacccgcggcgcattagctagttggtgaggtaacggcccaccaaggcaacgatgcgtagccgacctgagagggtgatcggccacattggaactgagacacggtccagactcctacgggaggcagcagtggggaatattgcgcaatgggggaaaccctgacgcagcaacgccgcgtgaatgatgaaggccttcgggttgtaaagttctgtcttctgggacgataatgacggtaccagaggaggaagccacggctaactacgtgccagcagccgcggtaatacgtaggtggcaagcgttgtccggatttactgggcgtaaaggatgcgtaggcggacatttaagtcagatgtgaaatacccgagcttaacttgggtgctgcatttgaaactgggtgtctagagtgcaggagaggtaagtggaattcctagtgtagcggtgaaatgcgtagagattaggaagaacaccagtggcgaaggcgacttactggactgtaactgacgctgaggcatgaaagcgtggggagcaaacaggattagataccctggtagtccacgccgtaaacgatgaatactaggtgtcgggggtcgaacctcggtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatcccctgcataacccagagatgggcgaagtccttcgggacagggtgacaggtggtgcatggttgtcgtcagctcgtgtcgtgagatgttgggttaagtcccgcaacgagcgcaacccttatcattagttgctaccatttagttgagcactctagtgagactgcccgggttaaccgggaggaaggtggggatgacgtcaaatcatcatgccccttatgtctagggctacacacgtgctacaatggtgagtacaaagagatgcaagaccgcaaggtggagccaaactcaaaaactcatcccagttcggattgtaggctgcaactcgcctacatgaagccggagttgctagtaatcgcgaatcagcatgtcgcggtgaatacgttcccgggccttgtacacaccgcccgtcacaccatgagagttggtaacacccgaagtccgtgaggtaaccgtaaggagccagcggccgaaggtgggattgatgattggggtgaagtcgtaacaaggtagccgtaggagaacctgcggctggatcacctcctttcta

SEQ ID NO: 566 - DNA, 936 bp, Clostridium tepidum
  ref <308>: DATABASE ACCESSION NUMBER: NCBI ACCESSION: NZ_MRAE01000098.1
  ref <309>: DATABASE ENTRY DATE: 2019-04-01
  ref <313>: RELEVANT RESIDUES IN SEQ ID NO: (1)..(936)
agtggggaatattgcgcaatgggggaaaccctgacgcagcaacgccgcgtgggtgatgaaggtcttcggattgtaaagccctgttttctgggacgataatgacggtaccagaggaggaagccacggctaactacgtgccagcagccgcggtaatacgtaggtggcgagcgttgtccggatttactgggcgtaaagggtgcgtaggcggatgtttaagtgggatgtgaaatccccgggcttaacctgggggctgcattccaaactggatatctagagtgcaagagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatggatactaggtgtagggggtatcaactccctctgtgccgcagttaacacaataagtatcccgcctggggagtacggtcgcaagattaaaactcaaaggaattgacgggggcccgcacaagcagcggagcatgtggtttaattcgaagcaacgcgaagaaccttacctggacttgacatcccttgcatagcctagagaaggtgaagcccttcggggcaaggagacaggtggtgcatggttgtcgtcagctcgtgtcgtgagatgttaggttaagtcctgcaacgagcgcaacccttgttattagttgctaccattaagttgagcactctaatgagactgcctgggtaaccaggaggaaggtggggatgacgtcaaatcatcatgccccttatgtccagggctacacacgtgctacaatggtaggtacaataagaggcaagaccgtgaggtggagcaaaacttataaagcctatctcagttcggattgtaggctgcaa

SEQ ID NO: 567 - DNA, 1521 bp, Clostridium tertium
  misc_feature (1004)..(1004): n is a, c, g, or t
  ref <308>: DATABASE ACCESSION NUMBER: NCBI ACCESSION: NZ_OBJV01000032.1
  ref <309>: DATABASE ENTRY DATE: 2019-04-01
  ref <313>: RELEVANT RESIDUES IN SEQ ID NO: (1)..(1521)
tttttattgagagtttgatcctggctcaggacgaacgctggcggcgtgcctaacacatgcaagtcgagcgagaggagttccttcgggaacaaatctagcggcggacgggtgagtaacacgtgggcaacctgccttgtagaggggaatagccttccgaaaggaagattaataccgcataacattacattttcgcatgaagaagtaattaaaggagcaatccgctacaagatgggcccgcggcgcattagctagttggtgaggtaacggctcaccaaggcaacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggatttttaagtgagatgtgaaatacccgggctcaacttgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattactcttaatcgaggaagtccnttcggggacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagatgcgataccgcgaggtggagctaaactataaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcgacctaaggtagggtcagcgattggggtgaagtcgtaacaaggtagccgtaggagaacctgcggctggatcacctcctttcta

SEQ ID NO: 568 - DNA, 1518 bp, Clostridium tetani
  ref <308>: DATABASE ACCESSION NUMBER: NCBI ACCESSION: NZ_UFXG01000001.1
  ref <309>: DATABASE ENTRY DATE: 2019-04-01
  ref <313>: RELEVANT RESIDUES IN SEQ ID NO: (1)..(1518)
tttaaattgagagtttgatcctggctcaggacgaacgctggcggcgtgcttaacacatgcaagtcgagcgatgaagcttccttcgggaagtggattagcggcggacgggtgagtaacacgtgggcaacctgcctcaaagaggggaatagccctccgaaaggaggattaataccgcataaagttaaggtttcgcatgaaactttaaccaaaggagtaatctgctttgagatgggcccgcgccccattagctagttggtaaggtaatggcttaccaaggcgacgatgggtagccgacctgagagggtgatcggccacattggaactgagacacggtccagactcctacgggaggcagcagtggggaatattgcgcaatgggggaaaccctgacgcagcaacgccgcgtgggtgatgaaggttttcggatcgtaaaaccctgttttctgggacgataatgacggtaccagatgaggaagccacggctaactacgtgccagcagccgcggtaatacgtaggtggcaagcgttgtccggatttactgggcgtaaagggtgcgtaggcggatacttaagtgagatgtgaaatacctaagcttaacttaggggctgcatttcaaactgggcatctagagtacaggagagggaaacggaattcctagtgtagcggtgaaatgcgtagagattaggaagaacaccagtggcgaaggcggtttcctggactgtaactgacgctgaggcacgaaagcgtgggtagcaaacaggattagataccctggtagtccacgccgtaaacgatgaatactaggtgtaggagggtccaaccttctgtgccgcagttaacacattaagtattccgcctggggagtacggtcgcaagactaaaactcaaaggaattgacgggggcccgcacaagcagcggagcatgtggtttaattcgaagcaacgcgaagaaccttacctagacttgacataccctgaattactcgtaactgaggaagtcccttcggggacagggatacaggtggtgcatggttgtcgtcagctcgtgtcgtgagatgttgggttaagtcccgcaacgagcgcaacccttattattagttgctaccattaagttgagcactctaatgagactgcctgggtgaaccaggaggaaggtggggatgacgtcaaatcatcatgccccttatgtctagggctacacacgtgctacaatggtcggtacagagagacgcaagaccgcgaggtggagcaaatctcaaaaaccgatcccagttcggattgcaggctgaaactcgcctgcatgaagccggagttgctagtaatcgcaaatcagaatgttgcggtgaatacgttcccgggccttgtacacaccgcccgtcacaccatgagagttggcaacacccgaagtccgtgaggtaaccgtaaggagccagcggccgaaggtggggttaatgattggggtgaagtcgtaacaaggtagccgtaggagaacctgcggctggatcacctcctttcta

SEQ ID NO: 569 - DNA, 1516 bp, Clostridium tetanomorphum
  ref <308>: DATABASE ACCESSION NUMBER: NCBI ACCESSION: NZ_UAWI01000011.1
  ref <309>: DATABASE ENTRY DATE: 2019-04-01
  ref <313>: RELEVANT RESIDUES IN SEQ ID NO: (1)..(1516)
tttaaattgagagtttgatcctggctcaggacgaacgctggcggcgtgcctaacacatgcaagtcgagcgatgaagtcccttcggggatagattagcggcggacgggtgagtaacacgtgggcaacctgcctcaaagtgggggatagccctccgaaaggaggattaataccgcataacattagttttccgcatgaaaaactaatcaaaggagtaatccgctttgagatgggcccgcggtgcattagctagttggtgaggtaacagctcaccaaggccacgatgcatagccgacctgagagggtgatcggccacattggaactgagacacggtccagactcctacgggaggcagcagtggggaatattgcgcaatgggggaaaccctgacgcagcaacgccgcgtgggtgatgaaggtcttcggattgtaaaaccctgtcttctgggacgataatgacggtaccagaggaggaagccacggctaactacgtgccagcagccgcggtaatacgtaggtggcgagcgttgtccggatttactgggcgtaaaggatgcgtaggcgggcatttaagtgagatgtgaaatccccgggcttaacttgggggctgcatttcaaactgggtgcctagagtgcaggagaggtaagtggaattcctagtgtagcggtgaaatgcgtagagattaggaagaacaccagtggcgaaggcgacttactggactgtaactgacgctgaggcatgaaagcgtgggtagcaaacaggattagataccctggtagtccacgccgtaaacgatgaatactaggtgtaggaggtatcgaccccttctgtgccgcagttaacacaataagtattccgcctggggagtacggtcgcaagattaaaactcaaaggaattgacgggggcccgcacaagcagcggagcatgtggtttaattcgaagcaacgcgaagaaccttacctagacttgacatcccctgaattactcgtaacggaggaagcccttcggggcagggagacaggtggtgcatggttgtcgtcagctcgtgtcgtgagatgttgggttaagtcccgcaacgagcgcaacccttatcattagttgctaccattaagttgagcactctaatgagactgcccgggttaaccgggaggaaggtggggatgacgtcaaatcatcatgccccttatgtctagggctacacacgtgctacaatggtgagtacagagagatgcaagaccgcaaggtggagctaaactcaaaaactcatcccagttcggattgtaggctgaaactcgcctacatgaagccggagttgctagtaatcgcgaatcagcatgtcgcggtgaatacgttcccgggccttgtacacaccgcccgtcacaccatgagagttggcaacacccgaagtccgtgaggtaaccgtaaggagccagcggccgaaggtggggtcaatgattggggtgaagtcgtaacaaggtagccgtaggagaacctgcggctggatcacctcctttcta

SEQ ID NO: 570 - DNA, 233 bp, Clostridium thermopalmarium
  ref <308>: DATABASE ACCESSION NUMBER: NCBI ACCESSION: NZ_QEQN01000049.1
  ref <309>: DATABASE ENTRY DATE: 2019-04-01
  ref <313>: RELEVANT RESIDUES IN SEQ ID NO: (1)..(233)
tttaatttgagagtttgatcctggctcaggacgaacgctggcggcgtgcctaacacatgcaagtcgagcgagaagagctccttcgggagtaattctagcggcggacgggtgagtaacacgtgggcaacctaccttagtgagggggatagcctcccgaaagggagattaataccgcataacattattctatcgcatgataggataatcaaaggagcaatccgcactaagatggg

SEQ ID NO: 571 - DNA, 1516 bp, Clostridium tunisiense
  ref <308>: DATABASE ACCESSION NUMBER: NCBI ACCESSION: NZ_AMQH01000037.1
  ref <309>: DATABASE ENTRY DATE: 2019-04-01
  ref <313>: RELEVANT RESIDUES IN SEQ ID NO: (1)..(1516)
tttaaattgagagtttgatcctggctcaggacgaacgctggcggcgtgcctaacacatgcaagtcgagcgatgaaacccttcggggtggattagcggcggacgggtgagtaacacgtgggtaacctgcctcatagagggggatagcctcccgaaagggagattaataccgcataatgtattttgttcgcatgaataaaatatcaaaggagtaatccactatgagatggacccgcggcgcattagctagttggtgaggtaacggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgatgaaggccttagggttgtaaagttctgtcttctgggacgataatgacggtaccagaggaggaagccacggctaactacgtgccagcagccgcggtaatacgtaggtggcaagcgttgtccggatttactgggcgtaaaggatgcgtaggcggatatttaagtcagatgtgaaatacccgggctcaacttgggtgctgcatttgaaactggatatctagagtgcgggagaggtaagtggaattcctagtgtagcggtgaaatgcgtagagattaggaagaacaccagtggcgaaggcgacttactggaccgtaactgacgctgaggcatgaaagcgtggggagcaaacaggattagataccctggtagtccacgccgtaaacgatgaatactaggtgtaggaggtatcgaccccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttatcattagttgctaccattaagttgagcactctagtgagactgccacggttaacgtggaggaaggtggggatgacgtcaaatcatcatgccccttatgtctagggctacacacgtgctacaatggtgagtacaaagagatgcaataccgcgaggtggagccaaactcaaaaactcatcccagttcggattgtaggctgaaactcgcctacatgaagccggagttgctagtaatcgcgaatcagcatgtcgcggtgaatacgttcccgggccttgtacacaccgcccgtcacaccatgagagctggtaacacccgaagtccgtgaggtaacccgcaagggagccagcggccgaaggtgggattagtgattggggtgaagtcgtaacaaggtagccgtaggagaacctgcggctggatcacctcctttcta

SEQ ID NO: 572 - DNA, 1519 bp, Clostridium uliginosum
  ref <308>: DATABASE ACCESSION NUMBER: NCBI ACCESSION: NZ_FOMG01000058.1
  ref <309>: DATABASE ENTRY DATE: 2019-04-01
  ref <313>: RELEVANT RESIDUES IN SEQ ID NO: (1)..(1519)
tttttaatgagagtttgatcctggctcaggacgaacgctggcggcgtgcctaacacatgcaagtcgagcgatgaagcttcttcggaagtggattagcggcggacgggtgagtaacacgtgggtaacctgcctcatagtgggggatagccttccgaaaggaagattaataccctataagattgtagcttcgcatgaagtagcaataaaaggagcaatccgctatgagatggacccgcgtcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggccttcgggttgtaaaactctgtctttggggacgataatgacggtacccaaggaggaagccacggctaactacgtgccagcagccgcggtaatacgtaggtggcaagcgttgtccggatttactgggcgtaaagggagcgtaggtggatatttaagtgggatgtgaaatgctcgggcttaacccgagagctgcattccaaactggatatctagagtgcaggagaggaaagtggaattcctagtgtagcggtgaaatgcgtagatattaggaagaacaccagtggcgaaggcgactttctggactgtaactgacactgaggctcgaaagcgtggggagcgaacaggattagataccctggtagtccacgccgtaaacgatgaatactaggtgtgggggttgtcatgacctccgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacagagagatgctaaaccgcgaggtggagccaaacttcaaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcgacctaaggtagggtcagcgattggggtgaagtcgtaacaaggtagccgtaggagaacctgcggctggatcacctcctttcta

SEQ ID NO: 573 - DNA, 1520 bp, Clostridium ventriculi
  ref <308>: DATABASE ACCESSION NUMBER: NCBI ACCESSION: NZ_UAUL01000012.1
  ref <309>: DATABASE ENTRY DATE: 2019-04-01
  ref <313>: RELEVANT RESIDUES IN SEQ ID NO: (1)..(1520)
tttaatttgagagtttgatcctggctcaggatgaacgctggcggcgtgcttaacacatgcaagtcgagcgagaaaagttcttcggagcttttctagcggcggacgggtgagtaacacgtgggcaacctgcctcatagaggggaatagccttccgaaaggaagattaataccgcataacattgttgaaaggcatcttttaacaatcaaaggagcaatccgctatgagatgggcctgcggcgcattagctagttggtgaggtaacggctcaccaaggcgacgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggattgtaaagctctgtctttagggacgataatgacggtacctaaggaggaagccacggctaactacgtgccagcagccgcggtaatacgtaggtggcaagcgttatccggatttactgggcgtaaagggagcgtaggcggatatttaagtgggatgtgaaatacccgagcttaacttgggagctgcattccaaactggatatctagagtgcaggagaggagaatggaattcctagtgtagcggtgaaatgcgtagagattaggaagaacaccagtggcgaaggcgattctctggactgtaactgacgctgaggctcgaaagcgtggggagcaaacaggattagataccctggtagtccacgccataaacgatgaatactaggtgtaggggccccaagcctctgtgccgccgctaacgcattaagtattccgcctggggagtacggtcgcaagattaaaactcaaaggaattgacggggacccgcacaagcagcggagcatgtggtttaattcgaagcaacgcgaagaaccttacctagacttgacatgtcttgaattaccagtaatgtgggaagttccttcgggaacaggaacacaggtggtgcatggttgtcgtcagctcgtgtcgtgagatgttgggttaagtcccgcaacgagcgcaacccttattgttagttggtaccattaagttgaccactctagcgagactgcccgggttaaccgggaggaaggtggggatgacgtcaaatcatcatgccccttatgtctagggctacacacgtgctacaatggcaagtacaaagagaagcaatactgtgaagtggagcaaaactcaaaaacttgtctcagttcggattgtaggctgaaactcgcctacatgaagctggagttgctagtaatcgcgaatcagaatgtcgcggtgaatacgttcccgggtcttgtacacaccgcccgtcacaccatgagagttggcaatacccgaagtccgtaagctaaccgtaaggaggcagcggccgaaggtagggtcagcgattggggtgaagtcgtaacaaggtagccgtaggagaacctgcggctggatcacctcctttctaaggaa

SEQ ID NO: 574 - DNA, 1514 bp, Clostridium vincentii
  ref <308>: DATABASE ACCESSION NUMBER: NCBI ACCESSION: NZ_PVXQ01000083.1
  ref <309>: DATABASE ENTRY DATE: 2019-04-01
  ref <313>: RELEVANT RESIDUES IN SEQ ID NO: (1)..(1514)
attgagagtttgatcctggctcaggacgaacgctggcggcgtgcttaacacatgcaagtcgagcgatgaagcttcttcggaagcggattagcggcggacgggtgagtaacacgtgggcaacctgccctatagaggggaatagccttccgaaaggaagattaataccccataagattgtagtttcacatggaacagcaattaaaggagcaatccgctataggatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggccttcgggttgtaaagctctgtctttggggacgataatgacggtacccaaggaggaagccacggctaactacgtgccagcagccgcggtaatacgtaggtggcaagcgttgtccggatttactgggcgtaaagggagcgtaggcggatttttaagtgggatgtgaaatactcgggctcaacctgagtgctgcattccaaactggaagtctagagtacaggaggggaaagtggaattcctagtgtagcggtgaaatgcgtagatattaggaagaacaccggtggcgaaggcgactttctggactgtaactgacgctgaggctcgaaagcgtggggagcgaacaggattagataccctggtagtccacgccgtaaacgatgaatactaggtgtgggggttgtcatgacctccgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattacccttaatcggggaagtcctttcggggacaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggccggtacaaagagacgcaataccgcaaggtggagccaaactataaaaccggtctcagttcggattgcaggctgaaactcgcctgcatgaagctggagttgctagtaatcgcgaatcagaatgtcgcggtgaatacgttcccgggccttgtacacaccgcccgtcacaccacgagagttggcaatacccaaagttggtgatctaacccgcaagggaggaagccacctaaggtagggtcagcgattggggtgaagtcgtaacaaggtagccgtaggagaacctgcggctggatcacctcctttcta

SEQ ID NO: 575 - DNA, 1341 bp, Cohnella lupini
  ref <308>: DATABASE ACCESSION NUMBER: NCBI ACCESSION: NZ_QRDY01000062.1
  ref <309>: DATABASE ENTRY DATE: 2019-04-01
  ref <313>: RELEVANT RESIDUES IN SEQ ID NO: (1)..(1341)
aagctgtggcttgtggatgggcctgcggcgcattagctagttggtggggtaatggctcaccaaggcgacgatgcgtagccgacctgagagggtgaacggccacactgggactgagacacggcccagactcctacgggaggcagcagtagggaatcttccacaatgggcgaaagcctgatggagcaacgccgcgtgagtgaggaaggctttcgggtcgtaaagctctgttgccagggaagaataaggatgagagtaactgctcatccgatgacggtacctgagaagaaagccccggctaactacgtgccagcagccgcggtaatacgtagggggcaagcgttgtccggaattattgggcgtaaagcgcgcgcaggcggttctttaagtctggtgtctaagtgcggggctcaaccccgtgatgcactggaaactggggaacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgctgtaaacgatgagtgctaggtgttgggggtatcatgccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggctttccttcgggacagaggagacaggtggtgcatggttgtcgtcagctcgtgtcgtgagatgttgggttaagtcccgcaacgagcgcaacccctaaacttagttgccagcacttcgggtgggcactctaggttgactgccggtgacaaaccggaggaaggcggggatgacgtcaaatcatcatgccccttatgacctgggctacacacgtactacaatggccggtacaacgggctgcgaaaccgcgaggtggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaaggag

SEQ ID NO: 576 - DNA, 1559 bp, Cohnella phaseoli
  ref <308>: DATABASE ACCESSION NUMBER: NCBI ACCESSION: NZ_QRDZ01000072.1
  ref <309>: DATABASE ENTRY DATE: 2019-04-01
  ref <313>: RELEVANT RESIDUES IN SEQ ID NO: (1)..(1559)
atggagagtttgatcctggctcaggacgaacgctggcggcgtgcctaatacatgcaagtcgagcggatctctgatggagcttgctcctgatgaggttagcggcggacgggtgagtaacacgtaggcaacctgcccccaagatcgggataacattcggaaacgaatgctaagaccggatacacggtttggtcgcatgatcgaatcgggaaacacggagcaatctgtggcttgaggatgggcctgcggcgcattagctagttggtggggtaacggctcaccaaggcgacgatgcgtagccgacctgagagggtgaacggccacactgggactgagacacggcccagactcctacgggaggcagcagtagggaatcttccacaatgggcgaaagcctgatggagcaacgccgcgtgagtgaggaaggctttcgggtcgtaaagctctgttgccagggaagaataaggatcatttaactgatgatccgatgacggtacctgagaagaaagccccggctaactacgtgccagcagccgcggtaatacgtagggggcaagcgttgtccggaattattgggcgtaaagcgcgcgcaggcggctctttaagtctggtgtttaagtgcggggctcaaccccgtgacgcactggaaactggggagcttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgccgtaaacgatgagtgctaggtgttgggggtatcatgccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccggtagagatatcggcggccttcgggacagaggagacaggtggtgcatggttgtcgtcagctcgtgtcgtgagatgttgggttaagtcccgcaacgagcgcaacccttgaacttagttgccagcgagtaaggtcgggcactctaggttgactgccggtgacaaaccggaggaaggcggggatgacgtcaaatcatcatgccccttatgacctgggctacacacgtactacaatggccggtacaaagggccgcgaagccgcgaggtggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaaggag

SEQ ID NO: 577 - DNA, 1563 bp, Cohnella sp. 18JY8-7
  ref <308>: DATABASE ACCESSION NUMBER: NCBI ACCESSION: NZ_CP033433.1
  ref <309>: DATABASE ENTRY DATE: 2019-04-01
  ref <313>: RELEVANT RESIDUES IN SEQ ID NO: (1)..(1563)
cctttatggagagtttgatcctggctcaggacgaacgctggcggcgtgcctaatacatgcaagtcgagcggatctccgagggagcttgctcccgatgaggttagcggcggacgggtgagtaacacgtaggcaacctgcccataagaccgggataacattcggaaacgaatgctaagaccggatacgcagcgaggtcgcatgatcttgctgggaaacacggcgtaagctgtggcttatggatgggcctgcggcgcattagctagttggtgaggtaacggcccaccaaggcgacgatgcgtagccgacctgagagggtgaacggccacactgggactgagacacggcccagactcctacgggaggcagcagtagggaatcttccacaatggacgcaagtctgatggagcaacgccgcgtgagtgaggaaggccttcgggtcgtaaagctctgttgccagggaagaacgccagggagagtaactgctctctgggtgacggtacctgagaagaaagccccggctaactacgtgccagcagccgcggtaatacgtagggggcaagcgttgtccggaattattgggcgtaaagcgcgcgcaggcggtttcttaagtctggtgtctaagtgcggggctcaaccccgtgatgcactggaaactgggagacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgccgtaaacgatgagtgctaggtgtcgggggggtccacccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccccctgaatcctccagagatggaggcggccttcgggacaggggagacaggtggtgcatggttgtcgtcagctcgtgtcgtgagatgttgggttaagtcccgcaacgagcgcaacccttgagcttagttgccagcatgtaaaggtgggcactctaggctgactgccggtgacaaaccggaggaaggcggggatgacgtcaaatcatcatgccccttatgacctgggctacacacgtactacaatggccggtacaacgggtcgcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaaggag

SEQ ID NO: 578 - DNA, 1562 bp, Cohnella sp. AR92
  ref <308>: DATABASE ACCESSION NUMBER: NCBI ACCESSION: NZ_RZJR01000016.1
  ref <309>: DATABASE ENTRY DATE: 2019-04-01
  ref <313>: RELEVANT RESIDUES IN SEQ ID NO: (1)..(1562)
cctttatggagagtttgatcctggctcaggacgaacgctggcggcgtgcctaatacatgcaagtcgagcggatcttcttgagtagcttgctactyaagaaggttagcggcggacgggtgagtaacacgtaggcaacctgcccataagaccgggataacattcggaaacgaatgctaagaccggatacgcagractggggcatcccggttctgggaaacacggtgcaagctgtggcttatggatgggcctgcggcgcattagctagttggtggggtaacggcctaccaaggcgacgatgcgtagccgacctgagagggtgaacggccacactgggactgagacacggcccagactcctacgggaggcagcagtagggaatcttccacaatgggcgcaagcctgatggagcaacgccgcgtgagtgaggaaggctttcgggtcgtaaagctctgttgccagggaagaataagggccagttaactgctggtccgatgacggtacctgagaagaaagccccggctaactacgtgccagcagccgcggtaatacgtagggggcaagcgttgtccggaattattgggcgtaaagcgcgcgcaggcggtytyttaagtctggtgtttaagtgcggggctcaaccccgtgacgcactggaaactgggagacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgccgtaaacgatgagtgctaggtgttgggggggtccacccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtrcagagatgtacctttccttcgggacagaggagacaggtggtgcatggttgtcgtcagctcgtgtcgtgagatgttgggttaagtcccgcaacgagcgcaacccttgaatttagttgccagcacttcgggtgggcactctagattgactgccggtgacaaaccggaggaaggcggggatgacgtcaaatcatcatgccccttatgacctgggctacacacgtactacaatggccggtacaacgggctgcgaaggagcgatctggagcgaatcctataaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaaggag

SEQ ID NO: 579 - DNA, 392 bp, Cohnella sp. CIP 111063
  ref <308>: DATABASE ACCESSION NUMBER: NCBI ACCESSION: NZ_MWSG01000056.1
  ref <309>: DATABASE ENTRY DATE: 2019-04-01
  ref <313>: RELEVANT RESIDUES IN SEQ ID NO: (1)..(392)
cggtgacaaaccggaggaaggcggggatgacgtcaaatcatcatgccccttatgacctgggctacacacgtactacaatggccggtacaaagggcagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaaggag

SEQ ID NO: 580 - DNA, 1562 bp, Cohnella sp. K2E09-144
  ref <308>: DATABASE ACCESSION NUMBER: NCBI ACCESSION: NZ_QXJM01000016.1
  ref <309>: DATABASE ENTRY DATE: 2019-04-01
  ref <313>: RELEVANT RESIDUES IN SEQ ID NO: (1)..(1562)
ttaatggagagtttgatcctggctcaggacgaacgctggcggcgtgcctaatacatgcaagtcgagcggatctttgagggagcttgctcccgataaggttagcggcggacgggtgagtaacacgtaggcaacctgcccctaagactgggataacattcggaaacgaatgctaagaccggatacgcaagcctgtcgcatgacgggcttgggaaacacggagcaatctgtggtttagggatgggcctgcggcgcattagctagttggtggggtaacggctcaccaaggcgacgatgcgtagccgacctgagagggtgaacggccacactgggactgagacacggcccagactcctacgggaggcagcagtagggaatcttccacaatgggcgcaagcctgatggagcaacgccgcgtgagtgaggaaggctttcgggtcgtaaagctctgttgccagggaagaataagggtgtgttaactgcacattcgatgacggtacctgagaagaaagccccggctaactacgtgccagcagccgcggtaatacgtagggggcaagcgttgtccggaattattgggcgtaaagcgcgcgcaggcggtcttttaagtctggtgtctaagtgcggggctcaaccccgtgatgcactggaaactgggagacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgccgtaaacgatgagtgctaggtgttgggggggtccacccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgaacttagttgccagcacgttaaggtgggcactctaggttgactgccggtgacaaaccggaggaaggcggggatgacgtcaaatcatcatgccccttatgacctgggctacacacgtactacaatggccggtacaacgggctgcgaaggagcgatccggagccaatcccagcaaagccggtctcagttcggattgtaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaaggag

SEQ ID NO: 581 - DNA, 1013 bp, Cohnella sp. M2MS4P-1
  ref <308>: DATABASE ACCESSION NUMBER: NCBI ACCESSION: NZ_RBZM01000028.1
  ref <309>: DATABASE ENTRY DATE: 2019-04-01
  ref <313>: RELEVANT RESIDUES IN SEQ ID NO: (1)..(1013)
ttatggagagtttgatcctggctcaggacgaacgctggcggcgtgcctaatacatgcaagtcgaacgaatctagaagttagcttgctaacttctaggttagtggcggacgggtgagtaacacgtaggcaacctgcccctaagatcgggataacattcggaaacgaatgctaagaccggatacataagttgatcgcatggtcggcttaggaaacacggtgcaagctgtggcttagggatgggcctgcggcgcattagctagttggtggggtaacggctcaccaaggcgacgatgcgtagccgacctgagagggtgaacggccacactgggactgagacacggcccagactcctacgggaggcagcagtagggaatcttccacaatgggcgaaagcctgatggagcaacgccgcgtgagtgaggaaggctttcgggtcgtaaagctctgttgccagggaagaataagggtgagagtaactgctcatccgatgacggtacctgagaagaaagccccggctaactacgtgccagcagccgcggtaatacgtagggggcaagcgttgtccggaattattgggcgtaaagcgcgcgcaggcggttctttaagtctggtgtctaagtgcggggctcaaccccgtgatgcactggaaactggggaacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgccgtaaacgatgagtgctaggtgttgggggtatcatgccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctga

SEQ ID NO: 582 - DNA, 1356 bp, Cohnella sp. OV312
  ref <308>: DATABASE ACCESSION NUMBER: NCBI ACCESSION: NZ_QKLR01000027.1
  ref <309>: DATABASE ENTRY DATE: 2019-04-01
  ref <313>: RELEVANT RESIDUES IN SEQ ID NO: (1)..(1356)
gttgagaaacacggtgcaagctgtggctttgggatgggcctgcggcgcattagctagttggtggggtaacggctcaccaaggcgacgatgcgtagccgacctgagagggtgaacggccacactgggactgagacacggcccagactcctacgggaggcagcagtagggaatcttccacaatgggcgcaagcctgatggagcaacgccgcgtgagtgaggaaggctttcgggtcgtaaagctctgttgccagggaagaataaggatgtgttaactgcacattcgatgacggtacctgagaagaaagccccggctaactacgtgccagcagccgcggtaatacgtagggggcaagcgttgtccggaattattgggcgtaaagcgcgcgcaggcggtttcttaagtctggtgtctaagtgcggggctcaaccccgtgatgcactggaaactgggagacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgccgtaaacgatgagtgctaggtgttgggggggtccacccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtaccttcccttcggggcagaggagacaggtggtgcatggttgtcgtcagctcgtgtcgtgagatgttgggttaagtcccgcaacgagcgcaacccttggatttagttgccagcacttcgggtgggcactctagatcgactgccggtgacaaaccggaggaaggcggggatgacgtcaaatcatcatgccccttatgacctgggctacacacgtactacaatggccggtacaacgggctgcgaaggagcgatccggagccaatcctaccaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacccgcaagggagccagccgtcgaaggtggggtagatgattggggtgaagtcgtaacaaggtagccgtatcggaaggtgcggctggatcacctcctttctaagga

SEQ ID NO: 583 - DNA, 239 bp, Cohnella sp. OV330
  ref <308>: DATABASE ACCESSION NUMBER: NCBI ACCESSION: NZ_FOKE01000025.1
  ref <309>: DATABASE ENTRY DATE: 2019-04-01
  ref <313>: RELEVANT RESIDUES IN SEQ ID NO: (1)..(239)
ctatatggagagtttgatcctggctcaggacgaacgctggcggcgtgcctaatacatgcaagtcgagcggatctctgatggagcttgctcctgatgagattagcggcggacgggtgagtaacacgtaggcaacctgccctgaagaccgggataacattcggaaacgaatgctaagaccggataggcaacgaggtcgcatgatcttgttgagaaacacggtgcaagctgtggctttggga

SEQ ID NO: 584 - DNA, 392 bp, Cohnella sp. SGD-V74; identical to SEQ ID NO: 579
  ref <308>: DATABASE ACCESSION NUMBER: NCBI ACCESSION: NZ_PVYW01000056.1
  ref <309>: DATABASE ENTRY DATE: 2019-04-01
  ref <313>: RELEVANT RESIDUES IN SEQ ID NO: (1)..(392)

SEQ ID NO: 585 - DNA, 1279 bp, Dendrosporobacter quercicolus
  ref <308>: DATABASE ACCESSION NUMBER: NCBI ACCESSION: NZ_FNHB01000027.1
  ref <309>: DATABASE ENTRY DATE: 2019-04-01
  ref <313>: RELEVANT RESIDUES IN SEQ ID NO: (1)..(1279)
gatgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggatcgtaaagctctgtcttcaagggagaacgtgccttatgtaaataatgtaaggcaatgacggtacttgaggaggaagccacggctaactacgtgccagcagccgcggtaatacgtaggtggcgagcgttgtccggaattattgggcgtaaagggcgcgtaggcgggaatataagtctgtcttaaaagtgcggggctcaaccccgtgaggggatggaaactatatttcttgagtgcaggagaggaaagtggaattcccagtgtagcggtgaaatgcgtagatattgggaggaacaccagtggcgaaggcgactttctggactgtaactgacgctgaggcgcgaaagccagggtagtgaacgggattagataccccggtaatcctggccgtaaacgatgggtactaggtgtaggaggtatcgacccctcctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaggacttgacattgagtgaaaggtctagagatagacgcctctcttcggagacacaaaaacaggtggtgcatggctgtcgtcagctcgtgtcgtgagatgttgggttaagtcccgcaacgagcgcaacccttatcctatgttgccagcgagtagagtcgggaactcatgggagactgccgcagacaatgcggaggaaggcggggatgacgtcaagtcatcatgccccttatgtcctgggctacacacgtactacaatgggcttaaatagagggaagcgaagccgcgaggtgaagcgaaccccgaaaacaagctctcagttcggattgcaggctgcaactcgcctgcatgaagtcggaatcgctagtaatcgcagatcagcatgctgcggtgaatacgttcccgggccttgtacacaccgcccgtcacaccacgaaagttggaaacacccgaaaccggcgacttaacctgaaaaggagagaaccgtctaaggtggggccgatgattggggtgaagtcgtaacaaggtagccgtatcggaaggtgcggctggatcacctcctttctaaggaga

SEQ ID NO: 586 - DNA, 1669 bp, Desulfosporosinus acidiphilus
  ref <308>: DATABASE ACCESSION NUMBER: NCBI ACCESSION: NC_018068.1
  ref <309>: DATABASE ENTRY DATE: 2019-04-01
  ref <313>: RELEVANT RESIDUES IN SEQ ID NO: (1)..(1669)
ttttttggagagtttgatcctggctcaggacgaacgctggcggcgtgcctaacacatgcaagtcgaacggtctaatgcttaacactgagtgttcagtgacgttgggacagcgagagcgcgaagtatgagcgctccacgcatcaaaaagtaccaacacaatcggagagctgaacgttgagtgttaagtattagatagtggcggacgggtgagtaacgcgtgggtaacctgcccataaaaccgggacaactcttggaaacgagggctaataccggatacgcttaagaagcggcatcgctttttaaggaaagatggcctctgaaaatgctatcgcttatggatggacccgcgtctgattagctggttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttagggaagaacggtctcttcaggaatatggaggagacatgacggtacctaaggaggaagccccggctaactacgtgccagcagccgcggtaatacgtagggggcgagcgttgtccggaattattgggcgtaaagggcgcgtaggcgggtatttaagtccggtgtgaaagatcagggctcaaccctgagagtgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagggggtatcgacccctcctgtgccggagttaacacaataagcactccgcctggggagtacggccgcaaggttgaaactcaaaggaattgacgggggcccgcacaagcggtggagcatgtggtttaattcgacgcaacgcgaagaaccttaccagggcttgacatcctctgaactctctagaaatagggaggtgcccttcggggagcagagagacaggtggtgcatggttgtcgtcagctcgtgtcgtgagatgttgggttaagtcccgcaacgagcgcaacccctgtatttagttgctaacacgtcaaggtgagcactctagatagactgccggtgacaaaccggaggaaggtggggatgacgtcaaatcatcatgccccttatgtcctgggctacacacgtgctacaatggccggtacagacggaagcgaagccgcgaggtgaagccaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgcaagggagctagccgtcgaaggtggggccgataattggggtgaagtcgtaacaaggtagccgtatcggaaggtgcggctggatcacctcctttctaaggaga

SEQ ID NO: 587 - DNA, 1577 bp, Desulfosporosinus hippei
  ref <308>: DATABASE ACCESSION NUMBER: NCBI ACCESSION: NZ_FNCP01000068.1
  ref <309>: DATABASE ENTRY DATE: 2019-04-01
  ref <313>: RELEVANT RESIDUES IN SEQ ID NO: (1)..(1577)
ttttttggagagtttgatcctggctcaggacgaacgctggcggcgtgcctaacacatgcaagtcgaacggagaatttgataagcttgcttagaaaaattcttagtggcggacgggtgagtaacgcgtgggtaacctacccataaatccgggacaacccttggaaacgagggctaataccggataatcttagagcttggcatcaaggtttaaggaaagatggcctctgaagatgctatcgattatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttggggaagaacggtcgatttgaaaatattgagtcgacatgacggtacccaaggaggaagccccggctaactacgtgccagcagccgcggtaatacgtagggggcaagcgttgtccggaattattgggcgtaaagggcgcgtaggcggattattaagtctggtgtgaaagatcagggctcaaccctgagagtgcatcggaaactggtgatcttgaggacaggagaggaaagtggaattccacgtgtagcggtgaaatgcgtagatatgtggaggaacaccggtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccaaggcttgacatcctacgaatccctaggaaactaaggagtgcccttcggggagcgtagagacaggtggtgcatggttgtcgtcagctcgtgtcgtgagatgttgggttaagtcccgcaacgagcgcaacccctgtatttagttgctaacacgtaatggtgagcactctagatagactgccggtgataaaccggaggaaggtggggatgacgtcaaatcatcatgccccttatgtcttgggctacacacgtgctacaatggccggtacagacggaagcgaagccgcgaggtgaagcaaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgaaagggagctagccgtcgaaggtggggccgataattggggtgaagtcgtaacaaggtagccgtatcggaaggtgcggctggatcacctcctttctaaggaga

SEQ ID NO: 588 - DNA, 1578 bp, Desulfosporosinus meridiei
  ref <308>: DATABASE ACCESSION NUMBER: NCBI ACCESSION: NC_018515.1
  ref <309>: DATABASE ENTRY DATE: 2019-04-01
  ref <313>: RELEVANT RESIDUES IN SEQ ID NO: (1)..(1578)
ttttttggagagtttgatcctggctcaggacgaacgctggcggcgtgcctaacacatgcaagtcgaacggagaattttgaaaagtttactttgaaaaattcttagtggcggacgggtgagtaacgcgtgggtaacctacccataaatccgggacaacccttggaaacgagggctaataccggataatcttagagcctggcatcaggttttaaggaaagatggcctctgaagatgctatcgattatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttggggaagaacggtggctttgaaaatattgaggccacatgacggtacccaaggaggaagccccggctaactacgtgccagcagccgcggtaatacgtagggggcaagcgttgtccggaattattgggcgtaaagggcgcgtaggcggatttttaagtccggtgtgaaagatcagggctcaaccctgagagtgcatcggaaactgggaatcttgaggacaggagaggaaagtggaattccacgtgtagcggtgaaatgcgtagatatgtggaggaacaccggtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccaaggcttgacatcctacgaatctttaggaaactagggagtgcccttcggggagcgtagagacaggtggtgcatggttgtcgtcagctcgtgtcgtgagatgttgggttaagtcccgcaacgagcgcaacccctgtatttagttgctaacaagtaaggttgagcactctaaatagactgccggtgataaaccggaggaaggtggggatgacgtcaaatcatcatgccccttatgtcttgggctacacacgtgctacaatggccggtacagacggaagcgaagccgcgaggtgaagcaaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgaaagggggctagccgtcgaaggtggggccgataattggggtgaagtcgtaacaaggtagccgtatcggaaggtgcggctggatcacctcctttctaaggaga

SEQ ID NO: 589 - DNA, 1578 bp, Desulfosporosinus orientis
  ref <308>: DATABASE ACCESSION NUMBER: NCBI ACCESSION: NC_016584.1
  ref <309>: DATABASE ENTRY DATE: 2019-04-01
  ref <313>: RELEVANT RESIDUES IN SEQ ID NO: (1)..(1578)
ttttttggagagtttgatcctggctcaggacgaacgctggcggcgtgcctaacacatgcaagtcgaacggagattttctctgagtttacttagagaaaatcttagtggcggacgggtgagtaacgcgtgggtaacctgcccataaagccgggacaacccttggaaacgagggctaataccggataatcttagatcttggcatcaggacttaaggaaagatggcctctgaacatgctatcgattatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtcattggggaagaacggtctttttgaaaatattgaggagacatgacggtacccaaggaggaagccccggctaactacgtgccagcagccgcggtaatacgtagggggcgagcgttgtccggaattattgggcgtaaagggcgcgtaggcggatgcttaagtccggtgtgaaagatcagggctcaaccctgagagtgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccagggcttgacatccacagaactccgtggaaacatggaggtgcccttcggggagctgtgagacaggtggtgcatggttgtcgtcagctcgtgtcgtgagatgttgggttaagtcccgcaacgagcgcaacccctgtatttagttgctaacaagtaaggttgagcactctagatagactgccggtgacaaaccggaggaaggtggggatgacgtcaaatcatcatgccccttatgtcctgggctacacacgtgctacaatggccggtacagacggaagcgaagccgcgaggtgaagccaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtggggtaacccgcaagggagctagccgtcgaaggtggggccgatgattggggtgaagtcgtaacaaggtagccgtatcggaaggtgcggctggatcacctcctttctaaggaga

SEQ ID NO: 590 - DNA, 1575 bp, Desulfosporosinus sp. FKA
  ref <308>: DATABASE ACCESSION NUMBER: NCBI ACCESSION: NZ_NAHZ01000025.1
  ref <309>: DATABASE ENTRY DATE: 2019-04-01
  ref <313>: RELEVANT RESIDUES IN SEQ ID NO: (1)..(1575)
ttttttggagagtttgatcctggctcaggacgaacgctggcggcgtgcttaacacatgcaagtcgaacggagagaattctaagtttacttagaaggatcttagtggcggacgggtgagtaacgcgtgggtaacctacccaacaaccgggacaacccttggaaacgagggctaataccggatacgcttaggagttggcatcaacttttaaggaaaggcggcctctgaatatgctgccgatgatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtttttagggaagaacggtttcttcaggaatatggaggagacatgacggtacctaaggaggaagccccggctaactacgtgccagcagccgcggtaatacgtagggggcgagcgttgtccggaattattgggcgtaaagggcgcgtaggcgggtatttaagtccggtgtgaaagatcagggctcaaccctgagagtgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagggggtatcgacccctcctgtgccggagttaacacaataagcactccgcctggggagtacggccgcaaggttgaaactcaaaggaattgacgggggcccgcacaagcggtggagcatgtggtttaattcgacgcaacgcgaagaaccttaccagggcttgacatcctctgaatcctttggaaacaagggagtgcccttcggggagcagagagacaggtggtgcatggttgtcgtcagctcgtgtcgtgagatgttgggttaagtcccgcaacgagcgcaacccctgtattcagttgctaacaagtaaggttgagcactctggatagactgccggtgacaaaccggaggaaggtggggatgacgtcaaatcatcatgccccttatgtcctgggctacacacgtgctacaatggccggtacagacggaagcgaagccgtgaggtgaagccaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgcaagggagctagccgtcgaaggtggggccgataattggggtgaagtcgtaacaaggtagccgtatcggaaggtgcggctggatcacctcctttctaaggaga

SEQ ID NO: 591 - DNA, 1668 bp, Desulfosporosinus sp. FKB
  ref <308>: DATABASE ACCESSION NUMBER: NCBI ACCESSION: NZ_NADJ01000015.1
  ref <309>: DATABASE ENTRY DATE: 2019-04-01
  ref <313>: RELEVANT RESIDUES IN SEQ ID NO: (1)..(1668)
ttttttggagagtttgatcctggctcaggacgaacgctggcggcgtgcctaacacatgcaagtcgaacggtctaatgcttaacactgagtgttcagtgaagttgggacagcgagagcgcgaagcatgagcgctccacgcattaaaagtgccaacatacttgggaaacggaacgctgagtgttaagtattagatagtggcggacgggtgagtaacgcgtgggtaacctacccaacaaaccgggataacccttggaaacgagggctaataccggatacgcttataagttggcatcaacgtataaggaaaggtggcctctgaatatgctgccgatgaaggatggacccgcgtctgattagctggttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtttttagggaagaacggtctcttcaggaatatggaggagacatgacggtacctaaggaggaagccccggctaactacgtgccagcagccgcggtaatacgtagggggcgagcgttgtccggaattattgggcgtaaagggcgcgtaggcgggtatttaagtccggtgtgaaagatcagggctcgaccctgagagtgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagggggtatcgacccctcctgtgccggagttaacacaataagcactccgcctggggagtacggccgcaaggttgaaactcaaaggaattgacgggggcccgcacaagcggtggagcatgtggtttaattcgacgcaacgcgaagaaccttaccagggcttgacatcctctgaatccaatggaaacatgggagtgcccttcggggaacagagagacaggtggtgcatggttgtcgtcagctcgtgtcgtgagatgttgggttaagtcccgcaacgagcgcaacccctgtattcagttgctaacaagtaaggttgagcactctggatagactgccggtgacaaaccggaggaaggtggggatgacgtcaaatcatcatgccccttatgttctgggctacacacgtgctacaatggccggtacagacggaagcgaagccgcgaggtgaagccaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgcaagggagctagccgtcgaaggtggggccgataattggggtgaagtcgtaacaaggtagccgtatcggaaggtgcggctggatcacctcctttctaaggaga

SEQ ID NO: 592 - DNA, 1022 bp, Desulfosporosinus sp. OT
  ref <308>: DATABASE ACCESSION NUMBER: NCBI ACCESSION: NZ_AGAF01000035.1
  ref <309>: DATABASE ENTRY DATE: 2019-04-01
  ref <313>: RELEVANT RESIDUES IN SEQ ID NO: (1)..(1022)
atgacggtacccaaggaggaagccccggctaactacgtgccagcagccgcggtaatacgtagggggcaagcgttgtccggaattattgggcgtaaagggcgcgtaggcggatgcttaagtccggtgtgaaagatcagggctcaaccctgagagtgcatcggaaactgggtatcttgaggacaggagaggaaagtggaattcctagtgtagcggtgaaatgcgtagatattaggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccagggcttgacatctacagaattcctaggaaactagggagtgcccttcggggagctgtaagacaggtggtgcatggttgtcgtcagctcgtgtcgtgagatgttgggttaagtcccgcaacgagcgcaacccctgtgtttagttgctaacgcgtagtggcgagcactctagacagactgccggtgataaaccggaggaaggtggggatgacgtcaaatcatcatgccccttatgtcctgggctacacacgtgctacaatggccggtacagacggaagcgaagccgcgaggtgaagcaaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgcaagggagctagccgtcgaaggtggggccgatgattggggtgaag

SEQ ID NO: 593 - DNA, 1674 bp, Desulfosporosinus youngiae
  ref <308>: DATABASE ACCESSION NUMBER: NCBI ACCESSION: NZ_CM001441.1
  ref <309>: DATABASE ENTRY DATE: 2019-04-01
  ref <313>: RELEVANT RESIDUES IN SEQ ID NO: (1)..(1674)
ttttttggagagtttgatcctggctcaggacgaacgctggcggcgtgcctaacacatgcaagtcgaacggtctaatgcttaacactgagtgttcagtagagttggggacagcgagagcgcaaagaatgagcgctccgcgcacttcataagtgccaacacaggtagaggaagctgaatgttgagtgttaagtattagatagtggcggacgggtgagtaacgcgtgggtaacctacccataaagccgggacaacccttggaaacgagggctaataccggataatcttaagatgtggcatcacgacttaaggaaagatggcctctgaaaatgctatcgattatggatggacccgcgtctgattagctggttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttggggaagaacggtgaggttgaaaagattgatttcacatgacggtacccaaggaggaagccccggctaactacgtgccagcagccgcggtaatacgtagggggcaagcgttgtccggaattattgggcgtaaagggcgcgtaggcggatttttaagtctggtgtgaaagatcagggctcaaccctgagagtgcatcggaaactggagatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaggcggtggagcatgtggtttaattcgacgcaacgcgaagaaccttaccaaggcttggacatcctctgaaccctgtggaaacatgggggtgcccttcggggagcagagagacaggtggtgcatggttgtcgtcagctcgtgtcgtgagatgttgggttaagtcccgcaacgagcgcaacccctgtatttagttgctaacaagtgaagttgagcactctagatagactgccggtgataaaccggaggaaggtggggatgacgtcaaatcatcatgccccttatgtcttgggctacacacgtgctacaatggccggtacagacggaagcgaagccgcgaggtgaagccaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgaaagggagctagccgtcgaaggtggggccgataattggggtgaagtcgtaacaaggtagccgtatcggaaggtgcggctggatcacctcctttctaaggaga

SEQ ID NO: 594 - DNA, 1540 bp, Desulfotomaculum nigrificans
  ref <308>: DATABASE ACCESSION NUMBER: NCBI ACCESSION: NC_015565.1
  ref <309>: DATABASE ENTRY DATE: 2019-04-01
  ref <313>: RELEVANT RESIDUES IN SEQ ID NO: (1)..(1540)
tttatggagagtttgatcctggctcaggacgaacgctggcggcgtgcctaacacatgcaagtcgaacggggtttagaatgaagcttgcgatttctaaacctagtggcggacgggtgagtaacgcgtggataacctgcctggtagaccgggataacagctggaaacggctgctaataccggatacgctcttggggccgcatggtgccgagaggaaaggggagccgctatcagatggatccgcgtcccattagctggttggtggtgtagcggaccaccaaggcgacgatgggtagccggcctgagagggcgaccggccacactgggactgagacacggcccagactcctacgggaggcagcagtggggaatcttccgcaatgggcgaaaagcctgacggagcaacgccgcgtgagggaagaaggccttcgggttgtaaacctctgtcctaaaggaagaaagaaatgacggtactttaggaggaagccccggctaactacgtgccagcagccgcggtaaaacgtagggggcgagcgttgtccggaattactgggcgtaaagggcgcgtaggtggtccattaagttagaggtgaaagtgcggggcttaaccccgtgagtgcctctgatactggtggacttgagtgcaggagaggggagcggaattcccagtgtagcggtgaaatgcgtagatattgggaggaacaccagtggcgaaggcggctctctggactgtaactgacactgaggcgcgaaagcgtggggagcaaacaggattagataccctggtagtccacgccgtaaacgatgagtgctaggtgttgcgggtatcgacccctgcagtgccgcagtaaacacaataagcactccgcctggggagtacggtcgcaagactgaaactcaaaggaattgacgggggcccgcacaagcggtggagtatgtggtttaattcgacgcaacgcgaagaaccttaccagggcttgacatcgcgcgacagctctagagatagagggttctgccttagggtagacgcgcagacaggtggtgcatggttgtcgtcagctcgtgtcgtgagatgttgggttaagtcccgcaacgagcgcaacccctaacattagttgccagcgagagagacggggactctaatgtgactgccgttgacaaaacggaggaaggtggggatgacgtcaaatcatcatgccccttatgtcctgggctacacacgtactacaatggccggtacaaacggaggcgaaggcgtgagccggagcaaaactgagaaagccggtctcagttcggattgtagtctgcaactcgactacatgaagtcggaatcgctagtaatcgcaggtcagcatactgcggtgaatacgttcccgggccttgtacacaccgcccgtcacaccacgaaagctgacaacacccgaagccggtgagctaactcgaaagagaggcagccgtcgaaggtggggtcggtgattggggtgaagtcgtaacaaggtagccgtatcggaaggtgcggctggatcacctcctttctaaggag

SEQ ID NO: 595 - DNA, 1613 bp, Desulfotomaculum profundi
  ref <308>: DATABASE ACCESSION NUMBER: NCBI ACCESSION: NZ_AWQQ01000055.1
  ref <309>: DATABASE ENTRY DATE: 2019-04-01
  ref <313>: RELEVANT RESIDUES IN SEQ ID NO: (1)..(1613)
taatttatggagagtttgatcctggctcaggacgaacgctggcggcgtgcttaacacatgcaagtcgaacggttcagtcgtcggtcttcagacgtcggacgtcgggatagtaaggaattcgccttagcgaattccagatttaaatccctgacgactgccgcctgacgaccgacgaccgaatagtggcgcacgggtgagtaacgcgtggataacctgcctggtagaccgggataacagctggaaacggctgctaataccggatacgcttaagagaacgcatgttcttttaaggaaagcaatygtgctatcagatggatccgcgtcccattagctagttggtggtgtaagggaccaccaaggcgacgatgggtagccggcctgagaggcgaccggccacactgggactgagacacggcccagactcctacgggaggcagcagtggggaatcttccgcaatgggcgaaagcctgacggagcaacgccgcgtgagggaagaaggccttcgggttgtaaacctctgtcatcaaggaagaacagatgacggtacttggagaggaagccccggctaactacgtgccagcagccgcggtaaaacgtagggggcgagcgttgtccggaattactgggcgtaaagggcgcgtaggtggtccattaagttagaggtgaaagatcggggctcaaccccgagattgcctctgatactggtggacttgagtgcaggagaggggagcggaattcccagtgtagcggtgaaatgcgtagatattgggaggaacaccagtggcgaaggcggctctctggactgtaactgacactgaggcgcgaaagcgtggggagcgaacaggattagataccctggtagtccacgccgtaaacgatgagtgctaggtgttgcgggtatcgacccccgcagtgccgtagttaacacaataagcactccgcctggggagtacggtcgcaagactgaaactcaaaggaattgacgggggcccgcacaagcggtggagtatgtggtttaattcgacgcaacgcgaagaaccttaccagggcttgacatcctctgaaagccatagagatatggaccttacttcggggtaacagagagacaggtggtgcatggttgtcgtcagctcgtgtcgtgagatgttgggttaagtcccgcaacgagcgcaacccctaacattagttgccagcgagtaaggtcgggaactctaatgtgactgccgttgacaaaacggaggaaggtggggatgacgtcaaatcatcatgccccttatgtcctgggctacacacgtactacaatggccggtacagacggaagcgaagccgtgaggcggagcaaawctgagaaagccggtcccagttcggattgtagtctgcaactcgactacatgaagtcggaatcgctagtaatcgcaggtcagcatactgcggtgaatacgttcccgggccttgtacacaccgcccgtcacaccacgaaagctgacaacacccgaagccggtgagctaaccgaaaggaggcagccgtcgaaggtggggttggtgattggggtgaagtcgtaacaaggtagccgtatcggaaggtgcggctggatcacctcctttctaagga

SEQ ID NO: 596 - DNA, 1486 bp, Geobacillus galactosidasius
  ref <308>: DATABASE ACCESSION NUMBER: NCBI ACCESSION: NZ_NDYL01000001.1
  ref <309>: DATABASE ENTRY DATE: 2019-04-01
  ref <313>: RELEVANT RESIDUES IN SEQ ID NO: (1)..(1486)
ctttttggagagtttgatcctggctcaggacgaacgctggcggcgtgcctaatacatgcaagtcgagcggaccgaacggaagcttgcttctgttcggttagcggcggacgggaagaccgcatggtctttggttgaaaggtggcttttgctaccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttttccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcccccttcggggggacagggtgacaggtggtgcatggttgtcgtcagctcgtgtcgtgagatgttgggttaagtcccgcaacgagcgcaaccctcgcccctagttgccagcattcagttgggcactctagggggactgccggtgacaaaccggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgtaagggagccagccgccgaaggtggggcaagtgattggggtgaagtcgtaacaaggtagccgtaccggaaggtgcggctggatcacctcctttctaa

SEQ ID NO: 597 - DNA, 1467 bp, Geobacillus icigianus
  ref <308>: DATABASE ACCESSION NUMBER: NCBI ACCESSION: NZ_JPYA01000033.1
  ref <309>: DATABASE ENTRY DATE: 2019-04-01
  ref <313>: RELEVANT RESIDUES IN SEQ ID NO: (1)..(1467)
ggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgtttgaacaaggcggcgcggtgacggtacctcacgagaaagccccggctaactacgtgccagcagccgcggtaatacgtagggggcgagcgttgtccggaattattgggcgtaaagcgcgcgcaggcggctccttaagtctgatgtgaaagcccacggctcaaccgtggagggtcattggaaactggggagcttgagtgcaggagaggggagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgaccacccaagagattgggcgttcccccttcggggggacagggtgacaggtggtgcatggttgtcgtcagctcgtgtcgtgagatgttgggttaagtcccgcaacgagcgcaaccctcgcctctcgttgccagcattcagttgggcactctagagggactgccggcgacaagtcggaggaaggtggggatgacgtcaaatcatcatgccccttatgacctgggctacacacgtgctacaatgggcggtacaaagggcagcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgcggtaaccctgacgggagccagccgccgaaggtggggcaagtgattggggtgaagtcgtaacaaggtagccgtaccggaaggtgcggctggatcacctcctttcta

SEQ ID NO: 598 - DNA, 1564 bp, Geobacillus lituanicus
  ref <308>: DATABASE ACCESSION NUMBER: NCBI ACCESSION: NZ_CP017692.1
  ref <309>: DATABASE ENTRY DATE: 2019-04-01
  ref <313>: RELEVANT RESIDUES IN SEQ ID NO: (1)..(1564)
ttctttggagagtttgatcctggctcaggacgaacgctggcggcgtgcctaatacatgcaagtcgagcggaccgaacgagggcttgctcttgtttggtcagcggcggacgggtgagtaacacgtgggcaacctgcccgcaagaccgggataactccgggaaaccggagctaataccggataacaccgaagaccgcatggtcttcggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgtacctgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcagttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttctaa

SEQ ID NO: 599 - DNA, 1467 bp, Geobacillus sp. A8
  ref <308>: DATABASE ACCESSION NUMBER: NCBI ACCESSION: NZ_JZIT01000086.1
  ref <309>: DATABASE ENTRY DATE: 2019-04-01
  ref <313>: RELEVANT RESIDUES IN SEQ ID NO: (1)..(1467)
ggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtggacggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggccccttaagtctgatgtgaaagcccacggctcaaccgtggagggtcattggaaactggggggcttgagggcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacctcctttcta

SEQ ID NO: 600 - DNA, 1564 bp, Geobacillus sp. FJAT-46040
  ref <308>: DATABASE ACCESSION NUMBER: NCBI ACCESSION: NZ_NISS01000001.1
  ref <309>: DATABASE ENTRY DATE: 2019-04-01
  ref <313>: RELEVANT RESIDUES IN SEQ ID NO: (1)..(1564)
tcttttggagagtttgatcctggctcaggacgaacgctggcggcgtgcctaatacatgcaagtcgagcggaccgaacgagggcttgctcttgtttggtcagcggcggacgggtgagtaacacgtgggcaacctgcccgcaagaccgggataactccgggaaaccggagctaataccggataacaccgaagaccgcatggtcttcggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactaggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatcacctcctttctaa

SEQ ID NO: 601 - DNA, 1560 bp, Geobacillus sp. JS12
  ref <308>: DATABASE ACCESSION NUMBER: NCBI ACCESSION: NZ_CP014749.1
  ref <309>: DATABASE ENTRY DATE: 2019-04-01
  ref <313>: RELEVANT RESIDUES IN SEQ ID NO: (1)..(1560)
cttttggagagtttgatcctggctcaggacgaacgctggcggcgtgcctaatacatgcaagtcgagcggaccgaacgggagcttgctctcgtttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagctggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcagttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacctcctttct

SEQ ID NO: 602 - DNA, 958 bp, Geobacillus sp. LYN3
  ref <308>: DATABASE ACCESSION NUMBER: NCBI ACCESSION: NZ_QCWL01000108.1
  ref <309>: DATABASE ENTRY DATE: 2019-04-01
  ref <313>: RELEVANT RESIDUES IN SEQ ID NO: (1)..(958)
ttcggttagcggcggacgggtgagtaacacgtgggtaacctgcccgtaagaccgggataactccgggaaaccggggctaataccggataacaccgaagaccgcatggtctttggttgaaaggtggcttttgctaccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttaaaccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcccccttcgggggg

SEQ ID NO: 603 - DNA, 1468 bp, Geobacillus sp. Manikaran-105
  ref <308>: DATABASE ACCESSION NUMBER: NCBI ACCESSION: NZ_PIJG01000125.1
  ref <309>: DATABASE ENTRY DATE: 2019-04-01
  ref <313>: RELEVANT RESIDUES IN SEQ ID NO: (1)..(1468)
ggtcagcggcggacgggtgagtaacacgtgggcaacctgcccgcaagaccgggataactccgggaaaccggagctaataccggataacaccgaagaccgcatggtcttcggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttygaagarggcggcgcggtgacggtacctcacgagaaagccccggctaactacgtgccagcagccgcggtaatacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacaggattagataccctggtagtccacgccgtaaacgatgagtgctaagtgttagaggggtcacaccctttagtgctgyagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcggttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttcta

SEQ ID NO: 604 - DNA, 1561 bp, Geobacillus sp. WSUCF-018B
  ref <308>: DATABASE ACCESSION NUMBER: NCBI ACCESSION: NZ_PIJF01000127.1
  ref <309>: DATABASE ENTRY DATE: 2019-04-01
  ref <313>: RELEVANT RESIDUES IN SEQ ID NO: (1)..(1561)
tctttggagagtttgatcctggctcaggacgaacgctggcggcgtgcctaatacatgcaagtcgagcggaccgaacgagggcttgctcttgtttggtcagcggcggacgggtgagtaacacgtgggcaacctgcccgcaagaccgggataactccgggaaaccggagctaataccggataacaccgaagaccgcatggtcttcggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttygaagarggcggcgcggtgacggtacctcacgagaaagccccggctaactacgtgccagcagccgcggtaatacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgyacctgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcggttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttct

SEQ ID NO: 605 - DNA, 1370 bp, Geobacillus sp. WSUCF1
  ref <308>: DATABASE ACCESSION NUMBER: NCBI ACCESSION: NZ_ATCO01000178.1
  ref <309>: DATABASE ENTRY DATE: 2019-04-01
  ref <313>: RELEVANT RESIDUES IN SEQ ID NO: (1)..(1370)
tggtttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggggcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgagg

SEQ ID NO: 606 - DNA, 1359 bp, Geobacillus stearothermophilus
  ref <308>: DATABASE ACCESSION NUMBER: NCBI ACCESSION: NZ_RCTK01000106.1
  ref <309>: DATABASE ENTRY DATE: 2019-04-01
  ref <313>: RELEVANT RESIDUES IN SEQ ID NO: (1)..(1359)
ggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcggttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttcta

SEQ ID NO: 607 - DNA, 1564 bp, Geobacillus thermocatenulatus
  ref <308>: DATABASE ACCESSION NUMBER: NCBI ACCESSION: NZ_CP018058.1
  ref <309>: DATABASE ENTRY DATE: 2019-04-01
  ref <313>: RELEVANT RESIDUES IN SEQ ID NO: (1)..(1564)
tcttttggagagtttgatcctggctcaggacgaacgctggcggcgtgcctaatacatgcaagtcgagcggaccggatcggggcttgccttgattcggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtggacggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggtgcggtgacggtacctcacgagaaagccccggctaactacgtgccagcagccgcggtaatacgtagggggcgagcgttgtccggaattattgggcgtaaagcgcgcgcaggcggccccttaagtctgatgtgaaagcccacggctcaaccgtggagggtcattggaaactgggggggcttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacctcctttctaa

SEQ ID NO: 608 - DNA, 946 bp, Geobacillus thermodenitrificans
  ref <308>: DATABASE ACCESSION NUMBER: NCBI ACCESSION: NZ_PIZS01000125.1
  ref <309>: DATABASE ENTRY DATE: 2019-04-01
  ref <313>: RELEVANT RESIDUES IN SEQ ID NO: (1)..(946)
ggtcagcggcggacgggtgagtaacacgtgggcaacctgcccgcaagaccgggataactccgggaaaccggagctaataccggataacaccaaagaccgcatggtctttggttgaaaggcggcttcggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaagctctgttgtgagggacgaaggagcgccgtttgaataaggcggcgcggtgacggtacctcacgagaaagccccggctaactacgtgccagcagccgcggtaatacgtagggggcgagcgttgtccggaattattgggcgtaaagcgcgcgcaggcggtcctttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaagtgttagaggggtcacaccctttagtgctgtagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttccccc

SEQ ID NO: 609 - DNA, 1561 bp, Geobacillus thermoleovorans
  ref <308>: DATABASE ACCESSION NUMBER: NCBI ACCESSION: NZ_CP027303.2
  ref <309>: DATABASE ENTRY DATE: 2019-04-01
  ref <313>: RELEVANT RESIDUES IN SEQ ID NO: (1)..(1561)
cttttggagagtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcgggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgcggtaacccttacgggagccagccgccgaaggtggggcaagtgattggggtgaagtcgtaacaaggtagccgtaccggaaggtgcggctggatcacctcctttct

SEQ ID NO: 610 - DNA, 1682 bp, Geobacillus uzenensis
  ref <308>: DATABASE ACCESSION NUMBER: NCBI ACCESSION: NZ_NEWL01000009.1
  ref <309>: DATABASE ENTRY DATE: 2019-04-01
  ref <313>: RELEVANT RESIDUES IN SEQ ID NO: (1)..(1682)
ctttttggagagtttgatcctggctcaggacgaacgctggcggcgtgcctaatacatgcaagtcgagcggaccggatcagggcttgccttgatttggtcagcggcggacgggtgagtaacacgtgggcaacctgcccgcaagaccgggataactccgggaaaccggagctaataccggataacaccgaagaccgcatggtcttcggttgaaaggcggcctttggtcagcggcggacgggtgagtaacacgtgggcaacctgcccgcaagaccgggataactccgggaaaccggagctaataccggataacaccgaagaccgcatggtcttcggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaagctctgttgtgagggacgaaggagcgccgtttgaacaaggcggcgcggtgacggtacctcacgagaaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaacccttgcctctagttgccagcattcagttgggcactctagagggactgccggcgaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgccagccgccgaaggtggggcaagtgattggggtgaagtcgtaacaaggtagccgtaccggaaggtgcggctggatcacctcctttctaa

SEQ ID NO: 611 - DNA, 1234 bp, Geobacillus zalihae
  ref <308>: DATABASE ACCESSION NUMBER: NCBI ACCESSION: NZ_NAGE01000147.1
  ref <309>: DATABASE ENTRY DATE: 2019-04-01
  ref <313>: RELEVANT RESIDUES IN SEQ ID NO: (1)..(1234)
ggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggrgcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggtcycttaagtctgatgtgaaagcccacggctcaaccgtggagggtcattggaaactgggggacttgagkgcaggagaggagagcggaattccacgtgtagcggtgaaatgcgtagagatgtggaggaacaccagtggcgaaggcggctctctggcctgcamctgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcaykmagktgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtg

SEQ ID NO: 612 - DNA, 1097 bp, Geosporobacter subterraneus
  ref <308>: DATABASE ACCESSION NUMBER: NCBI ACCESSION: NZ_FQZV01000002.1
  ref <309>: DATABASE ENTRY DATE: 2019-04-01
  ref <313>: RELEVANT RESIDUES IN SEQ ID NO: (1)..(1097)
aagttgagttgagtgctagatagcggcggacgggtgagtaacgcgtgggcaacctgccctatacagggggataacacaccgaaaggtgtgctaataccccataacactgatgcttcgcatggagtgtcagtcaaagatttatcggtataggatgggcccgcgtctgattagctagttggtgaggtaatggctcaccaaggcgacgatcagtagccgacctgagagggtgatcggccacactggaactgagacacggtccagactcctacgggaggcagcagtggggaatattgcacaatgggggaaaccctgatgcagcaacgccgcgtgagcgatgaaggccttcgggtcgtaaagctctgtcctaagggaagaataatgacggtaccttaggaggaagccccggctaactacgtgccagcagccgcggtaatacgtagggggcaagcgttatccggaatcactgggcgtaaagggtgcgtaggcggccgataaagtctggggtgaaaggctacggcttaaccgtagtaagccttggaaacttattggcttgagtgcaggagaggtaagtggaattcctagtgtagcggtgaaatgcgtagatattaggaggaacaccagtggcgaaggcgacttactggactgtaactgacgctgaggcacgaaagcgtggggagcgaacaggattagataccctggtagtccacgccgtaaacgatgagtgctaggtgtcgggggcgacagccctcggtgccgcagctaacgcattaagcactccgcctggggagtacgctcgcaagagtgaaactcaaaggaattgacggggacccgcacaagcagcggagcatgtggtttaattcgaagcaacgcgaagaaccttaccaggacttgacatccctcgcattagccgtaacgggtgaaatcccttcggggacgaggagacaggtggtgcatggttgtcgtcagctcgtgtcgtgagatgttgggttaagtcccgcaacgagcgcaacccttgtctttagttgccagcaggtggcgctgggcactctagagagactgccggggataactcggaggaaggtggggatgacgtcaaa

SEQ ID NO: 613 - DNA, 1157 bp, Gracilibacillus dipsosauri
  ref <308>: DATABASE ACCESSION NUMBER: NCBI ACCESSION: NZ_QGTD01000010.1
  ref <309>: DATABASE ENTRY DATE: 2019-04-01
  ref <313>: RELEVANT RESIDUES IN SEQ ID NO: (1)..(1157)
tttatggagagtttgatcttggctcaggacgaacgctggcggcgtgcctaatacatgcaagtcgagcgcgggaagctgactgaatccttcgggaggacgtgagtggaacgagcggcggacgggtgagtaacacgtgggcaacctgcctgtaagactgggataactccgggaaaccggggctaataccggatagtactttggttcataggaaccgaagtggaaaggtggcgcaagctaccacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaacaagtaccgttcgaatagggcggtaccttgacggtacctatcgaggaagccccggctaactacgtgccagcagccgcggtaatacgtagggggcaagcgttgtccggaattattgggcgtaaagcgcgcgtaggcggtttcttaagtctgatgtgaaatcttgcggctcaaccgcaagcggtcattggaaactggggaacttgagtacagaagaggagagcggaattccacgtgtagcggtgaaatgcgtagagatgtggaggaacaccagtggcgaaggcggctctctggtctgtaactgacgctgaggtgcgaaagcgtggggagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcttcggatgtccctagagatagggagttcccttcggggaccgaatgacaggtggtgcatggttgtcgtcagctcgtgtcgtgagatgttgggttaagtcccgcaacgagcgcaacccttgatcttagttgccagcatt

SEQ ID NO: 614 - DNA, 336 bp, Gracilibacillus orientalis
  ref <308>: DATABASE ACCESSION NUMBER: NCBI ACCESSION: NZ_FOTR01000018.1
  ref <309>: DATABASE ENTRY DATE: 2019-04-01
  ref <313>: RELEVANT RESIDUES IN SEQ ID NO: (1)..(336)
tttattgagagtttgatcttggctcaggacgaacgctggcggcgtgcctaatacatgcaagtcgagcgcgggaagcttgtctgatctcttcggagtgaagcgagtgaaacgagcggcggacgggtgagtaacacgtgggcaacctacctataagactgggataactccgggaaaccggggctaataccggataacacttttcttcacatgaagggaagttgaaagatggcttcttgctatcacttatagatgggcccgcggcgcattagctagttggtgaggtaagagctcaccaaggcgacgatgcgtagccgacctgagagggtgatcggccac

SEQ ID NO: 615 - DNA, 231 bp, Gracilibacillus ureilyticus
  ref <308>: DATABASE ACCESSION NUMBER: NCBI ACCESSION: NZ_FOGL01000005.1
  ref <309>: DATABASE ENTRY DATE: 2019-04-01
  ref <313>: RELEVANT RESIDUES IN SEQ ID NO: (1)..(231)
tttattgagagtttgatcttggctcaggacgaacgctggcggcgtgcctaatacatgcaagtcgagcgcgggaagctaactgaatccttcgggaggacgttagtggaacgagcggcggacgggtgagtaacacgtgggcaacctgcctgtaagactgggataactccgggaaaccggggctaataccggataatacttctcctcacatgagggaaagttgaaaggtggctt

SEQ ID NO: 616 - DNA, 1477 bp, Halobacillus aidingensis
  ref <308>: DATABASE ACCESSION NUMBER: NCBI ACCESSION: NZ_FNIZ01000045.1
  ref <309>: DATABASE ENTRY DATE: 2019-04-01
  ref <313>: RELEVANT RESIDUES IN SEQ ID NO: (1)..(1477)
ggtgaagctcgtggaacgagcggcggacgggtgagtaacacgtgggcaacctgcctgtaagatcggaataaccccgggaaaccggggctaatgccgggtaatactttctttcgcatgaaggaaagttgaaagatggcttcttgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtgcgaatagagcggtaccttgacggtacctaacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggacaaccctagagatagggctttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttctaa

SEQ ID NO: 617 - DNA, 1480 bp, Halobacillus alkaliphilus
  ref <308>: DATABASE ACCESSION NUMBER: NCBI ACCESSION: NZ_FOOG01000093.1
  ref <309>: DATABASE ENTRY DATE: 2019-04-01
  ref <313>: RELEVANT RESIDUES IN SEQ ID NO: (1)..(1480)
gggggtgaagcttgtggaacgagcggcggacgggtgagtaacacgtgggcaacctgcctgtaagaccggaataaccccgggaaaccggggctaatgccgggtaacacctaccttcacctgaaggaaggttaaaagatggcttctcgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtgcgaatagagcggtaccttgacggtacctaacgaggaagccccggctaactacgtgccagcagccgcggtaatacgtagggggcaagcgttgtccggaattattgggcgtaaagcgcgcgcaggcggtttcttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggaccaccctagagatagggttttcccttcggggaccaagtgacaggtggtgcatggttgtcgtcagctcgtgtcgtgagatgttgggttaagtcccgcaacgagcgcaacccctaatcttagttgccagcatttagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttctaa

SEQ ID NO: 618 - DNA, 1570 bp, Halobacillus halophilus
  ref <308>: DATABASE ACCESSION NUMBER: NCBI ACCESSION: NZ_CP022106.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcgggaagcaagcggatccccttcgggggtgaagcttgtggaacgagcggcggacgggtgagtaacacgtgggcaacctgcctgtaagaccggaataaccccgggaaaccggggctaatgccggataacacctaccttcacctgaaggaaggttaaaagatggcttctcgctatcacttacagatgggcccgcggcgcattagctagttggtgaggtaatagctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtacgaatagagcggtaccttgacggtacctaacgaggaagccccggctaactacgtgccagcagccgcggtaatacgtagggggcaagcgttgtccggaattattgggcgtaaagcgcgcgcaggtggtttcttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggaccaccctagagatagggtcttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttcta

SEQ ID NO: 619 - DNA, 1570 bp, Halobacillus litoralis
  ref <308>: DATABASE ACCESSION NUMBER: NCBI ACCESSION: NZ_CP026118.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcgggaagcgagcggatccccttcgggggtgaagctcgtggaacgagcggcggacgggtgagtaacacgtgggcaacctacctgtaagattggaataaccccgggaaaccggggctaatgccgggtaatacttttcttcgcatgaaggaaagttgaaagatggcctctggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtgccgtgcgaatagaacggcaccttgacggtacctaacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggaccaccctagagatagggttttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttcta

SEQ ID NO: 620 - DNA, 1490 bp, Halobacillus sp. Marseille-P3879
  ref <308>: DATABASE ACCESSION NUMBER: NCBI ACCESSION: NZ_OESS01000008.1
  ref <309>: DATABASE ENTRY DATE: 2019-04-01
  ref <313>: RELEVANT RESIDUES IN SEQ ID NO: (1)..(1490)
tgatccccttcgggggtgacgctggtggaatgagcggcggacgggtgagtaacacgtgggcaacctgcctgtaagaccggaataaccccgggaaaccggggctaatgccgggtaacaccttctctcgcatgaggggaggttgaaagatggcttctcgctatcgcttacagatgggcccgcggcgcattagctagttggtgaggtaacagctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtgccgtgcgaatagagcggcaccttgacggtacctaacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggcccgccctggagacagggttttcccttcggggaccaagtgacaggtggtgcatggttgtcgtcagctcgtgtcgtgagatgttgggttaagtcccgcaacgagcgcaacccctaatcttagttgccagcattgagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttcta

SEQ ID NO: 621 - DNA, 1568 bp, Halobacillus sp. SKP4-6
  ref <308>: DATABASE ACCESSION NUMBER: NCBI ACCESSION: NZ_SCFO01000020.1
  ref <309>: DATABASE ENTRY DATE: 2019-04-01
  ref <313>: RELEVANT RESIDUES IN SEQ ID NO: (1)..(1568)
tttatggagagtttgatcctggctcaggacgaacgctggcggcgtgcctaatacatgcaagtcgagcgcgggaagcgagctgatcccttcggggtgacgctcgtggaacgagcggcggacgggtgagtaacacgtgggcaacctgcctgtaagatcggaataactccgggaaaccggagctaatgccgggtaacaccttctttcgcatgaaggaaggttaaaagatggcttctcgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacaagtaccgtgcgaatagagcggtaccttgacggtacctaacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcttcggaccaccctagagatagggtcttcccttcggggaccgaatgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgcctaaggtggggccaatgattggggtgaagtcgtaacaaggtagccgtatcggaaggtgcggctggatcacctcctttcta

SEQ ID NO: 622 - DNA, 1568 bp, Halobacillus trueperi
  ref <308>: DATABASE ACCESSION NUMBER: NCBI ACCESSION: NZ_QUAE01000047.1
  ref <309>: DATABASE ENTRY DATE: 2019-04-01
  ref <313>: RELEVANT RESIDUES IN SEQ ID NO: (1)..(1568)
tttatggagagtttgatcctggctcaggacgaacgctggcggcgtgcctaatacatgcaagtcgagcgcgggaagcgagtggatcccttcggggtgaagctcgtggaacgagcggcggacgggtgagtaacacgtgggcaacctgcctgtaagatcggaataaccccgggaaaccggggctaatgccgggtaatactttctttcgcatgaaggaaagttgaaagatggcttctagctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtgcgaatagagcggtaccttgacggtacctaacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggacatccctagagatagggctttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttcta

SEQ ID NO: 623 - DNA, 1522 bp, Laceyella sacchari
  ref <308>: DATABASE ACCESSION NUMBER: NCBI ACCESSION: NZ_CP025943.1
  ref <309>: DATABASE ENTRY DATE: 2019-04-01
  ref <313>: RELEVANT RESIDUES IN SEQ ID NO: (1)..(1522)
taacggagagtttgatcctggctcaggatgaacgctggcggcatgcctaatacatgcaagtcgtgcgggggtcttcggaccctagcggcgaacgggtgagtaacacgtgggcaacctgcccgtaagactgggataactccgggaaaccggtgctaataccagataatctctttctccgcatggagaaagagtaaaaggcttcggccacttacggatgggcccgcggcgcattagctagttggtgaggtaacggctcaccaaggcgacgatgcgtagccgacctgagagggtgatcggccacactgggactgagacacggcccagactcctacgggaggcagcagtagggaattttccgcaatgggcgaaagcctgacggagcaatgccgcgtgagtgatgacggccttcgggttgtaaaactctgttctgaaggaagaagttctgacggtacttcaggagaaagccccggctaactacgtgccagcagccgcggtaatacgtagggggcgagcgttatccggaattattgggcgtaaagcgcgcgcaggcggtcatttaagtcaggtgtgaaaggctgcggctcaaccgcagagcgggcacctgaaactgggtgacttgagtgcaggagaggagagcggaattcccggttgtagcggtggaatgcgtagagatcggaggaacaccatgggcgaaggcggctctctggcctgtttctgacgctgaggcgcgaaagcgtggggagcaaacaggattaggataccctggtagtccacgcctcgtaaacgactgagtgctaggtgtggggcagggtcctaccctcggttggccgaaggtaacccattaaggcactccggcctgggagtacggcccgcaaggctgaaaactcaaaggaattgacgggggcccgcacaagcggtggagcatgtggtttaattcgaagcaacgcgaagaaccttacagggcttgacatcccgctgaccgctccagagatggagccctcccttcggggcagcggtgacaggtggtgcatggttgtcgtcagctcgtgtcgtgagatgttgggttcagtcccgcaacgagcgcaacccttatcgctagttgccagcattcagttggggcactctagcgagacagccggtgaaagccggaaggaaggtggggatgacgtcaaatcatcatgcccttatgtcctgggctacacacgtgctacaatggccggtacaatggggtcgccaacccgcgagggggagcttaatcccacaaaaccggtctcagttcggatcgcaggctgcaactcgcctgcgtgaagccggaatcgctagtaatcgcggatcagcatgtcgcggtgaatacgttcccgggccttgtacacaccgcccgtcacaccacgagagtttgcaacacccgaagtcggtgaggtaacctttacggaaccagccgccgaaggtggggcagatgattggggtgaagtcgtaacaaggtatccctaccggaaggtggggatggatcacctcctttcta

SEQ ID NO: 624 - DNA, 1507 bp, Laceyella sediminis
  ref <308>: DATABASE ACCESSION NUMBER: NCBI ACCESSION: NZ_PVTZ01000040.1
  ref <309>: DATABASE ENTRY DATE: 2019-04-01
  ref <313>: RELEVANT RESIDUES IN SEQ ID NO: (1)..(1507)
taacggagagtttgatcctggctcaggatgaacgctggcggcatgcctaatacatgcaagtcgtgcgggggtcttcggaccctagcggcgaacgggtgagtaacacgtgggcaacctgcccgtaagactgggataactccgggaaaccggtgctaataccagataatctctttctccgcatggagaaagagtaaaaggcttcggccacttacggatgggcccgcggcgcattagctagttggtgaggtaacggctcaccaaggcgacgatgcgtagccgacctgagagggtgatcggccacactgggactgagacacggcccagactcctacgggaggcagcagtagggaattttccgcaatgggcgaaagcctgacggagcaatgccgcgtgagtgatgacggccttcgggttgtaaaactctgttctgaaggaagaagttctgacggtacttcaggagaaagccccggctaactacgtgccagcagccgcggtaatacgtagggggcgagcgttatccggaattattgggcgtaaagcgcgcgcaggcggtcatttaagtcaggtgtgaaaggctgcggctcaaccgcagagcggcacctgaaactggatgacttgagtgcaggagaggagagcggaattcccggtgtagcggtggaatgcgtagagatcgggaggaacaccagtggcgaaggcggctctctggcctgtttctgacgctgaggcgcgaaagcgtggggagcaaacaggattagataccctggtagtccacgccgtaaacgatgagtgctaggtgtcggggggtcctaccctcggtgccgaaggtaacccattaagcactccgcctggggagtacggccgcaaggctgaaactcaaaggaattgacgggggcccgcacaagcggtggagcatgtggtttaattcgaagcaacgcgaagaaccttaccagggcttgacatcccgctgaccgctccagagatggagcttcccttcggggcagcggtgacaggtggtgcatggttgtcgtcagctcgtgtcgtgagatgttgggttcagtcccgcaacgagcgcaacccttatcgctagttgccagcatttagttgggcactctagcgagacagccggtgaaagccggaggaaggtggggatgacgtcaaatcatcatgccccttatgtcctgggctacacacgtgctacaatggccggtacaatgggtcgccaacccgcgagggggagctaatcccacaaaaccggtctcagttcggatcgcaggctgcaactcgcctgcgtgaagccggaatcgctagtaatcgcggatcagcatgccgcggtgaatacgttcccgggccttgtacacaccgcccgtcacaccacgagagtttgcaacacccgaagtcggtgaggtaacctttacggaaccagccgccgaaggtggggcagatgattggggtgaagtcgtaacaaggtatccctaccggaaggtggggatggatcacctcctttcta

SEQ ID NO: 625 - DNA, 438 bp, Lentibacillus halodurans
  ref <308>: DATABASE ACCESSION NUMBER: NCBI ACCESSION: NZ_FOJW01000003.1
  ref <309>: DATABASE ENTRY DATE: 2019-04-01
  ref <313>: RELEVANT RESIDUES IN SEQ ID NO: (1)..(438)
tttattggagagtttgatcttggctcaggacgaacgctggcggcgtgcctaatacatgcaagtcgagcgcgggaagcaaactgaaatcttcggatggacgtttgtggaacgagcggcggacgggtgagtaacacgtgggcaacctacctgtaagaccgggataactcgcggaaacgcgagctaataccggataacacttttggtcgcatgatgagaagttgaaagacggctttgagctgtcacttacagatgggcccgcggcgcattagttagttggtgaggtaagagctcaccaaggcaacgatgcgtagccgacctgagagggtgaacggccacactgggactgagacacggcccagactcctacgggaggcagcagtagggaatcatccgcaatggacgaaagtctgacggtgcaacgccgcgtgagtgaagaag

SEQ ID NO: 626 - DNA, 615 bp, Lentibacillus persicus
  ref <308>: DATABASE ACCESSION NUMBER: NCBI ACCESSION: NZ_FOMR01000015.1
  ref <309>: DATABASE ENTRY DATE: 2019-04-01
  ref <313>: RELEVANT RESIDUES IN SEQ ID NO: (1)..(615)
ttttttggagagtttgatcttggctcaggacgaacgctggcggcgtgcctaatacatgcaagtcgagcgcgggaagcagcgggtcgcccttcggggcgcacccctgtggaacgagcggcggacgggtgagtaacacgtgggcaacctgcctgtaagactgggataactcgcggaaacgcgagctaataccggataatgcttgtggttgcatgatcacaagctgaaaggcggcctctggctgccacttacagatgggcccgcggcgcattagctagttggtaaggtaagagcttaccaaggcgacgatgcgtagccgacctgagagggtgatcggccacactgggactgagacacggcccagactcctacgggaggcagcagtagggaatcatccgcaatggacgaaagtctgacggtgcaacgccgcgtgagtgatgaaggttttcggatcgtaaaactctgttgtcagggaagaacacgtgctgttcgaacaggacagcatcttgacggtacctgaccagaaagccccggctaactacgtgccagcagccgcggtaatacgtagggggcaagcgttgtccggaattattgggcgtaaagcgcgcgcaggcggtc

SEQ ID NO: 627 - DNA, 1105 bp, Lentibacillus sediminis
  ref <308>: DATABASE ACCESSION NUMBER: NCBI ACCESSION: NZ_NIXK01000021.1
  ref <309>: DATABASE ENTRY DATE: 2019-04-01
  ref <313>: RELEVANT RESIDUES IN SEQ ID NO: (1)..(1105)
cagggaagaacacgtgccgcatgaataaggcggtgcattgacggtacctgaccagaaagccccggctaactacgtgccagcagccgcggtaatacgtagggggcaagcgttgtccggaattattgggcgtaaagcgcacgcaggcggtcttttaagtctgatgtgaaatctcgcggctcaaccgcgagcggtcattggaaactggaggacttgagtgcagaagaggagagtggaattccacgtgtagcggtgaaatgcgtagagatgtggaggaacaccagtggcgaaggcgactctctggtctgtaactgacgctgaggtgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgatggcggtagagataccgtgttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggaagcgaagccgcgaggttctagcaaatcccagaaaaccattcccagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggggccagccgccgaaggtgggaccaatgattggggtgaagtcgtaacaaggtagccgtatcggaaggtgcggctggatcacctcctttcta

SEQ ID NO: 628 - DNA, 1706 bp, Lentibacillus sp. Marseille-P4043
  misc_feature (232)..(232): n is a, c, g, or t
  ref <308>: DATABASE ACCESSION NUMBER: NCBI ACCESSION: NZ_LT984884.1
  ref <309>: DATABASE ENTRY DATE: 2019-04-01
  ref <313>: RELEVANT RESIDUES IN SEQ ID NO: (1)..(1706)
tttttggagagtttgatcttggctcaggacgaacgctggcggcgtgcctaatacatgcaagtcgagcgcgtgaaacttgctgaagccttcgggtggatgcttgtggatcgagcggcggacgggtgagtaacacgtgggcaacctgcctgtaagatcgggataacttcgggaaaccgaggctaataccggatgatactttttctcgcatgaggagaagttgaaagatggcttnggatgcttgtggatcgagcggcggacgggtgagtaacacgtgggcaacctgcctgtaagatcgggataacttcgggaaaccgaggctaataccggatgatactttttctcacatgaggagaagttgaaagatggcttctgctatcacttacagatgggcccgcggcgcattagctagttggtaaggtaatggcttaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcgttcgaatagggcggtaccttgacggtacctaaccagaaagccccggctaactacgtgccagcagccgcggtaatacgtagggggcaagcgttgtccggaattattgggcgtaaagcgcgcgcaggcggtcttttaagtctgatgtgaaatctcgtggcttaaccacgagcggtcattggaaactggagggcttgagtgcagaagaggagagtggaattccacgtgtagcggtgaaatgcgtagagatgtggaggaacaccagtggcgaaggcgactctctggtctgtaactgacgctgaggcgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgcaaactctagagatagagtgttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggcagcgaagccgcaaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacgcagacgcgagccagccgccgaaggtggggccaatgattggggtgaagtcgtaacaaggtagccgtatcggaaggtgcggctggatcacctcctttcta

SEQ ID NO: 629 - DNA, 1569 bp, Lentibacillus sp. SSKP1-9
  ref <308>: DATABASE ACCESSION NUMBER: NCBI ACCESSION: NZ_SEIO01000084.1
  ref <309>: DATABASE ENTRY DATE: 2019-04-01
  ref <313>: RELEVANT RESIDUES IN SEQ ID NO: (1)..(1569)
tttggagagtttgatcttggctcaggacgaacgctggcggcgtgcctaatacatgcaagtcgagcgcgggaagcaggcaaacacccttcggggtgtgcgcctgtggaacgagcggcggacgggtgagtaacacgtgggcaacctgcctgtaagactgggataactcgcggaaacgtgagctaataccggataatgtctttcctcgcatgagggagggctgaaagacggcctttgtgctgtcacttacaaatgggcccgcggcgcattagttagttggtgaggtaagagctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggtcttcggatcgtaaaactctgttgtcagggaagaacaagcgtggttcgaatagggccatgccttgacggtacctgaccagaaagccccggctaactacgtgccagcagccgcggtaatacgtagggggcaagcgttgtccggaattattgggcgtaaagcgcgcgcaggcggtttcttaagtctgatgtgaaatcttgcggcttaaccgcaagtggtcattggaaactgggaggcttgagtacagaagaggagagtggaattccacgtgtagcggtgaaatgcgtagagatgtggaggaacaccagtggcgaaggcgactctctggtctgtaactgacgctgaggcgcgaaagcgtgggtagcgaacaggattagataccctggtagtccacgccgtaaacgttgagtgctaggtgttagggggtttccgcccctttgtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacagcggcagagatgccgtgttcccttcggggacagagtgacaggtggtgcatggttgtcgtcagctcgtgtcgtgagatgttgggttaagtcccgtaacgagcgcaacccttgatcttagttgccagcattcagttgggcactctaaggtgactgccggtgacaaaccggaggaaggcggggatgacgtcaaatcatcatgccccttatgacctgggctacacacgtgctacaatggatggaacaaagggaagcgaagccgtgaggtgtagcaaatcccacaaaaccattctcagttcggattgcaggctgcaactcgcctgtatgaagccggaatcgctagtaatcgcggatcagcatgccgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttcta

SEQ ID NO: 630 - DNA, 879 bp, Lysinibacillus boronitolerans
  ref <308>: DATABASE ACCESSION NUMBER: NCBI ACCESSION: NZ_AVCW01000055.1
  ref <309>: DATABASE ENTRY DATE: 2019-04-01
  ref <313>: RELEVANT RESIDUES IN SEQ ID NO: (1)..(879)
ggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggggcggctggatcacctcctttctaagga

SEQ ID NO: 631 - DNA, 1555 bp, Lysinibacillus chungkukjangi
  ref <308>: DATABASE ACCESSION NUMBER: NCBI ACCESSION: NZ_QJTJ01000078.1
  ref <309>: DATABASE ENTRY DATE: 2019-04-01
  ref <313>: RELEVANT RESIDUES IN SEQ ID NO: (1)..(1555)
ttatggagagtttgatcctggctcaggacgaacgctggcggcgtgcctaatacatgcaagtcgagcggactttagaaaagcttgcttttctaaagttagcggcggacgggtgagtaacacgtgggcaacctgccctatagttggggataactccgggaaaccggggctaataccgaataatacattccttctcctgttggaatgttgaaagatggtttacgctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccattgaccgctatggagacatagctttcccttcggggacagtggtgacaggtggtgcatggttgtcgtcagctcgtgtcgtgagatgttgggttaagtcccgcaacgagcgcaacccttgttcttagttgccatcatttagttgggcactctaaggagactgccggtgacaaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagccggtggggtaacccttttgggagccagccgtcgaaggtgggacagatgattggggtgaagtcgtaacaaggtagccgtatcggaaggtgcggctggatcacctcctttct

SEQ ID NO: 632 - DNA, 1551 bp, Lysinibacillus composti
  ref <308>: DATABASE ACCESSION NUMBER: NCBI ACCESSION: NZ_RRCT01000049.1
  ref <309>: DATABASE ENTRY DATE: 2019-04-01
  ref <313>: RELEVANT RESIDUES IN SEQ ID NO: (1)..(1551)
ttatggagagtttgatcctggctcaggacgaacgctggcggcgtgcctaatacatgcaagtcgagcgaacttgcgggagcttgctcccaaaagttagcggcggacgggtgagtaacacgtgggcaacctgccctatagtttgggataactccgggaaaccggggctaataccgaataatacatttcatctcctgttggaatgttgaaagatggtttcggctatcgctataggatgggcccgcggcgcattagctagtaggtgaggtaacggctcacctaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtgcagtagtaactggctgcaccttgacggtaccttattagaaagccacggctaactacgtgccagcagccgcggtaatacgtaggtggcaagcgttgtccggaattattgggcgtaaagcgcgcgcaggcggtttcttaagtctgatgtgaaagcccccggcttaaccggggagggtcattggaaactgggagacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccactgaccgctatggagacatagttttcccttcggggacagtggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggggccagccgccgaaggtgggacagatgattggggtgaagtcgtaacaaggtagccgtatcggaaggtgcggctggatcacctcctttct

SEQ ID NO: 633 - DNA, 1550 bp, Lysinibacillus endophyticus
  ref <308>: DATABASE ACCESSION NUMBER: NCBI ACCESSION: NZ_RBZN01000109.1
  ref <309>: DATABASE ENTRY DATE: 2019-04-01
  ref <313>: RELEVANT RESIDUES IN SEQ ID NO: (1)..(1550)
ttatggagagtttgatcctggctcaggacgaacgctggcggcgtgcctaatacatgcaagtcgagcggacctttagaagcttgcttctgaaggttagcggcggacgggtgagtaacacgtgggcaacctgccctatagttggggataactccgggaaaccggggctaataccgaataattcatttcatcacatgttgaaatgatgaaagatggttctgctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccattgaccgctatggagacatagctttcccttcggggacagtggtgacaggtggtgcatggttgtcgtcagctcgtgtcgtgagatgttgggttaagtcccgcaacgagcgcaacccttgttcttagttgccatcatttagttgggcactctaaggagactgccggtgacaaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttct

SEQ ID NO: 634 - DNA, 1482 bp, Lysinibacillus fluoroglycofenilyticus
  ref <308>: DATABASE ACCESSION NUMBER: NCBI ACCESSION: NZ_PYWK01000014.1
  ref <309>: DATABASE ENTRY DATE: 2019-04-01
  ref <313>: RELEVANT RESIDUES IN SEQ ID NO: (1)..(1482)
tttggtgcttgcaccgaagtaacgctagcggcggacgggtgagtaacacgtgggcaacctgccctgtagatggggataactccgggaaaccggggctaataccgaatgatactttgagacacatgttttaaagttgaaagatggctctgctatcgctacaggatgggcccgcggcgcattagctagttggtgaggtaatggctcaccaaggcaacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtgccgtagtaactggcggcaccttgacggtaccttattagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggaaggtcattggaaactggggaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgcccactatggagacatggttttcccttcggggacaacggtgacaggtggtgcatggttgtcgtcagctcgtgtcgtgagatgttgggttaagtcccgcaacgagcgcaacccttgatcttagttgccatcattcagttgggcactctaaggtgactgccggtgacaaaccggaggaaggtggggatgacgtcaaatcatcatgccccttatgacctgggctacacacgtgctacaatggacggtacaaccggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttcta

SEQ ID NO: 635 - DNA, 1477 bp, Lysinibacillus fusiformis
  ref <308>: DATABASE ACCESSION NUMBER: NCBI ACCESSION: NZ_PXXY01000082.1
  ref <309>: DATABASE ENTRY DATE: 2019-04-01
  ref <313>: RELEVANT RESIDUES IN SEQ ID NO: (1)..(1477)
gacgaacgctggcggcgtgcctaatacatgcaagtcgagcgaacagagaaggagcttgctccttcgacgttagcggcggacgggtgagtaacacgtgggcaacctaccttatagtttgggataactccgggaaaccggggctaataccgaataatctgtttcacctcatggtgaaacactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaag

SEQ ID NO: 636 - DNA, 1354 bp, Lysinibacillus halotolerans
  ref <308>: DATABASE ACCESSION NUMBER: NCBI ACCESSION: NZ_RHLQ01000103.1
  ref <309>: DATABASE ENTRY DATE: 2019-04-01
  ref <313>: RELEVANT RESIDUES IN SEQ ID NO: (1)..(1354)
atgttgaaagatggcatctagctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccattgaccgctatggagacatagttttcccttcggggacagtggtgacaggtggtgcatggttgtcgtcagctcgtgtcgtgagatgttgggttaagtcccgcaacgagcgcaacccttgttcttagttgccatcatttagttgggcactctaaggagactgccggtgacaaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttcta

SEQ ID NO: 637 - DNA, 1553 bp, Lysinibacillus jejuensis
  ref <308>: DATABASE ACCESSION NUMBER: NCBI ACCESSION: NZ_QAFW01000116.1
  ref <309>: DATABASE ENTRY DATE: 2019-04-01
  ref <313>: RELEVANT RESIDUES IN SEQ ID NO: (1)..(1553)
ttatggagagtttgatcctggctcaggacgaacgctggcggcgtgcctaatacatgcaagtcgagcgaatgaaagagaagcttgcttctctggatttagcggcggacgggtgagtaacacgtgggcaacctaccttatagatggggataactccgggaaaccggggctaataccgaataactccaagcacctcctggtgcttggctgaaagacggtttcggctgtcactataagatgggcccgcggcgcattagctagttggtaaggtaacggcttaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggaaggtcattggaaactgggggacttgagtgcagaagaggttagtggaattccaagtgtagcggtgaaatgcgtagagatttggaggaacaccagtggcgaaggcgactaactggtctgtaactgacgctgaggcgcgaaagcgtggggagcaaacaggattagataccctggtagtccacgccgtaaacgatgagtgctaagtgttagggggtttccgccccttagtgctgcagtaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgttgaccactgtagagatatggttttcccttcggggacaacggtgacaggtggtgcatggttgtcgtcagctcgtgtcgtgagatgttgggttaagtcccgcaacgagcgcaacccttattcttagttgccatcatttagttgggcactctaaggagactgccggtgacaaaccggaggaaggtggggatgacgtcaaatcatcatgccccttatgacctgggctacacacgtgctacaatggacgatacaaacggttgccaacccgcgagggggagctaatccgataaaatcgttctcagttcggattgtaggctgcaactcgcctacatgaagccggaatcgctagtaatcgtggatcagcatgccacggtgaatacgttcccgggccttgtacacaccgcccgtcacaccacgagagtttgtaacaccctaagtcggtgaggtaaccttcgggagccagccgcctaaggtgggatagatgattggggtgaagtcgtaacaaggtagccgtatcggaaggtgcggctggatcacctcctttct

SEQ ID NO: 638 - DNA, 212 bp, Lysinibacillus mangiferihumi
  ref <308>: DATABASE ACCESSION NUMBER: NCBI ACCESSION: NZ_PYWM01000042.1
  ref <309>: DATABASE ENTRY DATE: 2019-04-01
  ref <313>: RELEVANT RESIDUES IN SEQ ID NO: (1)..(212)
tttatggagagtttgatcctggctcaggacgaacgctggcggcgtgcctaatacatgcaagtcgagcgaacagagaaggagcttactcctttgacgttagcggcggacgggtgagtaacacgtgggcaacctaccctatagtttgggataactccgggaaaccggggctaataccgaataatctattgtccctcatgggacaatactgaaag

SEQ ID NO: 639 - DNA, 217 bp, Lysinibacillus massiliensis
  ref <308>: DATABASE ACCESSION NUMBER: NCBI ACCESSION: NZ_AVCZ01000154.1
  ref <309>: DATABASE ENTRY DATE: 2019-04-01
  ref <313>: RELEVANT RESIDUES IN SEQ ID NO: (1)..(217)
ttttatggagagtttgatcctggctcaggacgaacgctggcggcgtgcctaatacatgcaagtcgagcggacggatgggagcttgctcccagaagttagcggcggacgggtgagtaacacgtgggcaacctgccctatagttggggataactccgggaaaccggggctaataccgaatgatacatttcatctcctgttgaaatgttgaaagatggtt

SEQ ID NO: 640 - DNA, 381 bp, Lysinibacillus meyeri
  ref <308>: DATABASE ACCESSION NUMBER: NCBI ACCESSION: NZ_PYWN01000135.1
  ref <309>: DATABASE ENTRY DATE: 2019-04-01
  ref <313>: RELEVANT RESIDUES IN SEQ ID NO: (1)..(381)
aaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaagga

SEQ ID NO: 641 - DNA, 421 bp, Lysinibacillus odysseyi
  ref <308>: DATABASE ACCESSION NUMBER: NCBI ACCESSION: NZ_AVCX01000029.1
  ref <309>: DATABASE ENTRY DATE: 2019-04-01
  ref <313>: RELEVANT RESIDUES IN SEQ ID NO: (1)..(421)
ttttatggagagtttgatcctggctcaggacgaacgctggcggcgtgcctaatacatgcaagtcgagcggacgttttgttggtgcttgcaccgacttaacgttagcggcggacgggtgagtaacacgtgggcaacctgccctgtagtctgggataactccgggaaaccggggctaataccggatgatactttttgattcatgtcagaaagttgaaagatggtttacgctatcgctacaggatgggcccgcggcgcattagctagttggtgaggtaacggctcaccaaggcaacgatgcgtagccgacctgagagggtgatcggccacactgggactgagacacggcccagactcctacgggaggcagcaggagggaatcttccacaatggacgaaagtctgatggagcaacgccgcgtgag

SEQ ID NO: 642 - DNA, 236 bp, Lysinibacillus sinduriensis
  ref <308>: DATABASE ACCESSION NUMBER: NCBI ACCESSION: NZ_AVCY01000005.1
  ref <309>: DATABASE ENTRY DATE: 2019-04-01
  ref <313>: RELEVANT RESIDUES IN SEQ ID NO: (1)..(236)
ttttatggagagtttgatcctggctcaggacgaacgctggcggcgtgcctaatacatgcaagtcgagcggacttgatgggagcttgctccttatcaagttagcggcggacgggtgagtaacacgtgggcaacctgccctatagttggggataactccgggaaaccggggctaataccgaataatacatttcttctcctgatgaaatgttgaaagatggtttacgctatcgctatag

SEQ ID NO: 643 - DNA, 1558 bp, Lysinibacillus sp. 2017
  ref <308>: DATABASE ACCESSION NUMBER: NCBI ACCESSION: NZ_CP029002.1
  ref <309>: DATABASE ENTRY DATE: 2019-04-01
  ref <313>: RELEVANT RESIDUES IN SEQ ID NO: (1)..(1558)
attatggagagtttgatcctggctcaggacgaacgctggcggcatgcctaatacatgcaagtcgagcggacgaacttttggtgcttgcactaaactttcgttagcggcggacgggtgagtaacacgtgggtaacctaccctacagactgggataacttcgggaaaccgaggctaataccggataatacttggaactacatagttccttgttgaaagatggttttgctatcactgtaagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccacaatgggcgaaagcctgatggagcaatgccgcgtgagtgaagaaggatttcggttcgtaaaactctgttgcaagggaagaacaagtagcgtagtaactggcgctaccttgacggtaccttgttagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccattgaccactgtagagatacagttttcccttcggggacaacggtgacaggtggtgcatggttgtcgtcagctcgtgtcgtgagatgttgggttaagtcccgcaacgagcgcaacccttgttcttagttgccatcatttagttgggcactctaaggagactgccggtgataaaccggaggaaggtggggatgacgtcaaatcatcatgccccttatgacctgggctacacacgtgctacaatggacgatacaaacggttgccaacccgcgagggggagctaatccgataaaatcgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggatagatgattggggtgaagtcgtaacaaggtagccgtatcggaaggtgcggctggatcacctcctttct

SEQ ID NO: 644 - DNA, 1507 bp, Lysinibacillus sp. BC-14
  ref <308>: DATABASE ACCESSION NUMBER: NCBI ACCESSION: NZ_FMYD01000001.1
  ref <309>: DATABASE ENTRY DATE: 2019-04-01
  ref <313>: RELEVANT RESIDUES IN SEQ ID NO: (1)..(1507)
aatacatgcaagtcgagcgaacagagaaggagcttgctccttcgacgttagcggcggacgggtgagtaacacgtgggcaacctaccttatagtttgggataactccgggaaaccggggctaataccgaataatctgtttcacctcatggtgaaacactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaa

SEQ ID NO: 645 - DNA, 1020 bp, Lysinibacillus sp. BC-43
  ref <308>: DATABASE ACCESSION NUMBER: NCBI ACCESSION: NZ_FOZT01000039.1
  ref <309>: DATABASE ENTRY DATE: 2019-04-01
  ref <313>: RELEVANT RESIDUES IN SEQ ID NO: (1)..(1020)
aagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaagg

SEQ ID NO: 646 - DNA, 1464 bp, Lysinibacillus sp. KCTC 33748
  ref <308>: DATABASE ACCESSION NUMBER: NCBI ACCESSION: NZ_MWSJ01000050.1
  ref <309>: DATABASE ENTRY DATE: 2019-04-01
  ref <313>: RELEVANT RESIDUES IN SEQ ID NO: (1)..(1464)
gacgttagcggcggacgggtgagtaacacgtgggcaacctaccttatagtttgggataactccgggaaaccggggctaataccgaataatctatttcacttcatggtgaaatactgaaagacggtttcggctgtcgctataagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatggttttcccttcggggacaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgccgaaggtgggatagatgattggggtgaagtcgtaacaaggtagccgtatcggaaggtgcggctggatcacctcctttctaa

SEQ ID NO: 647 - DNA, 1255 bp, Lysinibacillus sp. LD79
  ref <308>: DATABASE ACCESSION NUMBER: NCBI ACCESSION: NZ_FMVP01000046.1
  ref <309>: DATABASE ENTRY DATE: 2019-04-01
  ref <313>: RELEVANT RESIDUES IN SEQ ID NO: (1)..(1255)
gagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaagga

SEQ ID NO: 648 - DNA, 1552 bp, Lysinibacillus sp. Marseille-P5727
  ref <308>: DATABASE ACCESSION NUMBER: NCBI ACCESSION: NZ_LT985980.1
  ref <309>: DATABASE ENTRY DATE: 2019-04-01
  ref <313>: RELEVANT RESIDUES IN SEQ ID NO: (1)..(1552)
ttatggagagtttgatcctggctcaggacgaacgctggcggcgtgcctaatacatgcaagtcgagcggactgatgggagcttgctcccagatgttagcggcggacgggtgagtaacacgtgggcaacctgccctatagttggggataactccgggaaaccggggctaataccgaatgatactatttaactcctgttaaatagttgaaagatggttctgctatcgctataggatgggcccgcggcgcattagctagtaggtgaggtaacggctcacctaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaataagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagccctcggctcaaccgcggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctatggagacatagctttcccttcggggacagcggtgacaggtggtgcatggttgtcgtcagctcgtgtcgtgagatgttgggttaagtcccgcaacgagcgcaacccttgttcttagttgccatcatttagttgggcactctaaggagactgccggtgacaaaccggaggaaggtggggatgacgtcaaatcatcatgccccttatgacctgggctacacacgtgctacaatggacggtacaaacggttgccaactcgcgagagggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacgcatacgcgagccagccgccgaaggtgggacagatgattggggtgaagtcgtaacaaggtagccgtatcggaaggtgcggctggatcacctcctttct

SEQ ID NO: 649 - DNA, 1477 bp, Lysinibacillus sp. PB300
  ref <308>: DATABASE ACCESSION NUMBER: NCBI ACCESSION: NZ_PXXX01000046.1
  ref <309>: DATABASE ENTRY DATE: 2019-04-01
  ref <313>: RELEVANT RESIDUES IN SEQ ID NO: (1)..(1477)
gacgaacgctggcggcgtgcctaatacatgcaagtcgagcgaacagaaaaggagcttgctcctttgacgttagcggcggacgggtgagtaacacgtgggcaacctaccctatagtttgggataactccgggaaaccggggctaataccgaataatctcttttgcttcatggtgaaagactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaag

SEQ ID NO: 650 - DNA, 1247 bp, Lysinibacillus sp. SG45
  ref <308>: DATABASE ACCESSION NUMBER: NCBI ACCESSION: NZ_FOCR01000043.1
  ref <309>: DATABASE ENTRY DATE: 2019-04-01
  ref <313>: RELEVANT RESIDUES IN SEQ ID NO: (1)..(1247)
gatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaagga

SEQ ID NO: 651 - DNA, 1507 bp, Lysinibacillus sp. SG53; identical to SEQ ID NO: 644
  ref <308>: DATABASE ACCESSION NUMBER: NCBI ACCESSION: NZ_FOQQ01000002.1
  ref <309>: DATABASE ENTRY DATE: 2019-04-01
  ref <313>: RELEVANT RESIDUES IN SEQ ID NO: (1)..(1507)

SEQ ID NO: 652 - DNA, 1255 bp, Lysinibacillus sp. SG55
  ref <308>: DATABASE ACCESSION NUMBER: NCBI ACCESSION: NZ_FOZQ01000001.1
  ref <309>: DATABASE ENTRY DATE: 2019-04-01
  ref <313>: RELEVANT RESIDUES IN SEQ ID NO: (1)..(1255)
aaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctttt

SEQ ID NO: 653 - DNA, 1098 bp, Lysinibacillus sp. SG8
  ref <308>: DATABASE ACCESSION NUMBER: NCBI ACCESSION: NZ_FMUG01000036.1
  ref <309>: DATABASE ENTRY DATE: 2019-04-01
  ref <313>: RELEVANT RESIDUES IN SEQ ID NO: (1)..(1098)
aagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaagga

SEQ ID NO: 654 - DNA, 1259 bp, Lysinibacillus sp. SG9
  ref <308>: DATABASE ACCESSION NUMBER: NCBI ACCESSION: NZ_FMUO01000001.1
  ref <309>: DATABASE ENTRY DATE: 2019-04-01
  ref <313>: RELEVANT RESIDUES IN SEQ ID NO: (1)..(1259)
actaaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctttt

SEQ ID NO: 655 - DNA, 1478 bp, Lysinibacillus sp. SYSU K30002
  ref <308>: DATABASE ACCESSION NUMBER: NCBI ACCESSION: NZ_RYYR01000063.1
  ref <309>: DATABASE ENTRY DATE: 2019-04-01
  ref <313>: RELEVANT RESIDUES IN SEQ ID NO: (1)..(1478)
ggagcttgctcctaaaggttagcggcggacgggtgagtaacacgtgggcaacctgccctatagttggggataactccgggaaaccggagctaataccgaatgatacaatttaactcctgttagattgttgaaagatggtttcggctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggatttattgggcgtaaagcgcgcgcaggcggtcctttaagtctgatgtgaaagcccacggctcaaccgtggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccattgaccgctatggagacatggctttcccttcggggacagtggtgacaggtggtgcatggttgtcgtcagctcgtgtcgtgagatgttgggttaagtcccgcaacgagcgcaacccttgttcttagttgccatcatttagttgggcactctaaggagactgccggtgacaaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttct

SEQ ID NO: 656 - DNA, 964 bp, Lysinibacillus sp. TC-13
  ref <308>: DATABASE ACCESSION NUMBER: NCBI ACCESSION: NZ_FOEL01000044.1
  ref <309>: DATABASE ENTRY DATE: 2019-04-01
  ref <313>: RELEVANT RESIDUES IN SEQ ID NO: (1)..(964)
gtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaagga

SEQ ID NO: 657 - DNA, 278 bp, Lysinibacillus sp. TC-37
  ref <308>: DATABASE ACCESSION NUMBER: NCBI ACCESSION: NZ_FMXU01000014.1
  ref <309>: DATABASE ENTRY DATE: 2019-04-01
  ref <313>: RELEVANT RESIDUES IN SEQ ID NO: (1)..(278)
ttttatggagagtttgatcctggctcaggacgaacgctggcggcgtgcctaatacatgcaagtcgagcgaacagagaaggagcttgctcctttgacgttagcggcggacgggtgagtaacacgtgggcaacctaccttatagtttgggataactccgggaaaccggggctaataccgaataatctgtttcacctcatggtgaaacactaaaagacggtttcggctgtcgctataggatgggcccgcggcgcattagctagttggtgaggtaacggctc

SEQ ID NO: 658 - DNA, 1553 bp, Lysinibacillus sp. YLB-03
  ref <308>: DATABASE ACCESSION NUMBER: NCBI ACCESSION: NZ_QWEI01000026.1
  ref <309>: DATABASE ENTRY DATE: 2019-04-01
  ref <313>: RELEVANT RESIDUES IN SEQ ID NO: (1)..(1553)
ttatggagagtttgatcctggctcaggacgaacgctggcggcgtgcctaatacatgcaagtcgagcgaacagatgagaagcttgcttctctgatgttagcggcggacgggtgagtaacacgtgggcaacctgccctatagttggggataactccgggaaaccggggctaataccgaatgatacatttcatctcctgttggaatgttgaaagatggtttacgctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggatttattgggcgtaaagcgcgcgcaggtggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccactgaccgccatggagacatggctttcccttcggggacagtggtgacaggtggtgcatggttgtcgtcagctcgtgtcgtgagatgttgggttaagtcccgcaacgagcgcaacccttattcttagttgccatcattcagttgggcactctaaggagactgccggtgacaaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagccggtggggtaaccttttggagccagccgtcgaaggtgggacagatgattggggtgaagtcgtaacaaggtagccgtatcggaaggtgcggctggatcacctcctttct

SEQ ID NO: 659 - DNA, 1554 bp, Lysinibacillus sp. YS11
  ref <308>: DATABASE ACCESSION NUMBER: NCBI ACCESSION: NZ_CP026007.1
  ref <309>: DATABASE ENTRY DATE: 2019-04-01
  ref <313>: RELEVANT RESIDUES IN SEQ ID NO: (1)..(1554)
tttatggagagtttgatcctggctcaggacgaacgctggcggcgtgcctaatacatgcaagtcgagcgaacagaaaaggagcttgctcctttgacgttagcggcggacgggtgagtaacacgtgggcaacctaccctatagtttgggataactccgggaaaccggggctaataccgaataatctcttttgcttcatggtgaaagactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttct

SEQ ID NO: 660 - DNA, 1553 bp, Lysinibacillus sphaericus
  ref <308>: DATABASE ACCESSION NUMBER: NCBI ACCESSION: NZ_UYIR01000040.1
  ref <309>: DATABASE ENTRY DATE: 2019-04-01
  ref <313>: RELEVANT RESIDUES IN SEQ ID NO: (1)..(1553)
ttatggagagtttgatcctggctcaggacgaacgctggcggcatgcctaatacatgcaagtcgagcgaatcgataggagcttgctccttgagattagcggcggacgggtgagtaacacgtgggcaacctgccctgcagatggggataactccgggaaaccggggctaataccgaataatcaattccttcgcatgaaggaattctgaaagacggtttcggctgtcactgcaggatgggcccgcggcgcattagctagttggtggggtaatggcctaccaaggcaacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgcgagggaagaacacgtacgggagtaactgcccgtaccttgacggtacctcgtcagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccactgaccggcatggagacatgtctttcccttcggggacagtggtgacaggtggtgcatggttgtcgtcagctcgtgtcgtgagatgttgggttaagtcccgcaacgagcgcaacccttaatcttagttgccatcatttagttgggcactctaaggtgactgccggtgacaaaccggaggaaggtggggatgacgtcaaatcatcatgccccttatgacctgggctacacacgtgctacaatggacggtacagagggctgcaaacccgcgagggggagccaatcccagaaaaccgttcccagttcggattgtaggctgcaactcgcctacatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttct

SEQ ID NO: 661 - DNA, 348 bp, Lysinibacillus tabacifolii
  ref <308>: DATABASE ACCESSION NUMBER: NCBI ACCESSION: NZ_PYUE01000008.1
  ref <309>: DATABASE ENTRY DATE: 2019-04-01
  ref <313>: RELEVANT RESIDUES IN SEQ ID NO: (1)..(348)
tttatggagagtttgatcctggctcaggacgaacgctggcggcgtgcctaatacatgcaagtcgagcgaacagagaaggagcttgctcctttgacgttagcggcggacgggtgagtaacacgtgggcaacctaccctatagtttgggataactccgggaaaccggggctaataccgaataatctattgtccctcatgggacaatactgaaagacggtcttggctgtcgctataggatgggcccgcggcgcattagctagttggtgaggtaacggctcaccaaggcaacgatgcgtagccgacctgagagggtgatcggccacactgggactgagacacggcccagact

SEQ ID NO: 662 - DNA, 1365 bp, Lysinibacillus telephonicus
  ref <308>: DATABASE ACCESSION NUMBER: NCBI ACCESSION: NZ_RXNR01000152.1
  ref <309>: DATABASE ENTRY DATE: 2019-04-01
  ref <313>: RELEVANT RESIDUES IN SEQ ID NO: (1)..(1365)
gatgttagcggcggacgggtgagtaacacgtgggcaacctgccctatagttggggataactccgggaaaccggggctaataccgaatgattcatttcatctcctgatgaaatgctgaaagatggttctgctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctatggagacatagccttcccttcggggacagcggtgacaggtggtgcatggttgtcgtcagctcgtgtcgtgagatgttgggttaagtcccgcaacgagcgcaacccttgagattagttgccatcattcagttgggcactctaatctgactgccggtgataaaccggaggaaggtggggatgacgtcaaatcatcatgccccttatgacctgggctacacacgtgctacaatggacggtacaaacggttgccaacccgcgagggggagccaatccgataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaac

SEQ ID NO: 663 - DNA, 779 bp, Lysinibacillus xylanilyticus
  ref <308>: DATABASE ACCESSION NUMBER: NCBI ACCESSION: NZ_PHQY01000356.1
  ref <309>: DATABASE ENTRY DATE: 2019-04-01
  ref <313>: RELEVANT RESIDUES IN SEQ ID NO: (1)..(779)
tttcggctgtcgctataagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgggagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttacca

SEQ ID NO: 664 - DNA, 1549 bp, Lysinibacillus xyleni
  ref <308>: DATABASE ACCESSION NUMBER: NCBI ACCESSION: NZ_OBMQ01000025.1
  ref <309>: DATABASE ENTRY DATE: 2019-04-01
  ref <313>: RELEVANT RESIDUES IN SEQ ID NO: (1)..(1549)
ttatggagagtttgatcctggctcaggacgaacgctggcggcgtgcctaatacatgcaagtcgagcggacctttaggatttatcctgaaggttagcggcggacgggtgagtaacacgtgggcaacctgccctatagttggggataactccgggaaaccggggctaataccgaataattcatttcatcacatgttggaatgataaaagatggttttgctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccattgaccgctatggagacatagctttcccttcggggacagtggtgacaggtggtgcatggttgtcgtcagctcgtgtcgtgagatgttgggttaagtcccgcaacgagcgcaacccttgttcttagttgccatcatttagttgggcactctaaggagactgccggtgacaaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttcta

SEQ ID NO: 665 - DNA, 1570 bp, Moorella humiferrea
  ref <308>: DATABASE ACCESSION NUMBER: NCBI ACCESSION: NZ_PVXM01000026.1
  ref <309>: DATABASE ENTRY DATE: 2019-04-01
  ref <313>: RELEVANT RESIDUES IN SEQ ID NO: (1)..(1570)
ttcatggagagtttgatcctggctcaggactaacgctggcggcgtgcctaacacatgcaagtcgagcggtctttacctggtggaatcttcggaggaagccgggtagagatagcggcggacgggtgagtaacgcgtgggcaatctacccttcagaccgggataacactgggaaactggtgctaataccggatacgttccctgggaggcatcttccggggaagaaaagggaggcgacgaccgctgaaggatgagcccgcgtcccattagctagttggtgaggtaacggctcaccaaggcgacgatgggtagccggcctgagagggtggtcggccacactgggactgagacacggcccagactcctacgggaggcagcagtggggaatcttgcgcaatgggcgaaagcctgacgcagcgacgccgcgtgagcgatgaaggccttcgggtcgtaaagctctgtcatcagggacgaagtctcgctttaggcgaggtgacggtacctgaagaggaagccccggctaactacgtgccagcagccgcggtaagacgtagggggcgagcgttgtccggaattactgggcgtaaagggcgtgtaggcggcctggcaagtcagatgtgaaaaacccaggctcaacctgggggatgcatttgaaactgccgggcttgagggcaggagaggagagcggaattcccggtgtagcggtgaaatgcgtagatatcgggaggaacaccagtggcgaaggcggctctctggactgtacctgacgctgaggcgcgaaagcgtggggagcaaacaggattagataccctggtagtccacgccgtaaacgatgggtactaggtgttggaggtatcgacccctccagtgccgcagttaacacaataagtaccccgcctggggagtacggccgcaaggctgaaactcaaaggaattgacgggggcccgcacaagcggtggagcatgtggtttaattcgacgcaacgcgaagaaccttaccggggtttgacatcccgcgaacctggtggaaacactggggtgccggttttaccggaacgcggagacaggtggtgcatggttgtcgtcagctcgtgtcgtgagatgttgggttaagtcccgcaacgagcgcaacccctacctttagttgccagcacgtaatggtgggcactctaaagggactgccggtgacaaaccggaggaaggtggggatgacgtcaaatcatcatgccccttatatcccgggctacacacgtgctacaatggccggtacagaggggggcgaacccgcgagggggagcaaatcccaaaaagccggtctcagttcggattgcaggctgcaactcgcctgcatgaaggcggaatcgctagtaatcgcggatcagcatgccgcggtgaatacgttcccgggccttgtacacaccgcccgtcacaccacgaaagctggcaacacccgaagccggtgacccaacctgaaaaggagggagccgtcgaaggtggggctggtgattggggtgaagtcgtaacaaggtagccgtatcggaaggtgcggctggatcacctcctttctaaggag

SEQ ID NO: 666 - DNA, 1576 bp, Moorella sp. Hama-1
  ref <308>: DATABASE ACCESSION NUMBER: NCBI ACCESSION: NZ_BFFN01000045.1
  ref <309>: DATABASE ENTRY DATE: 2019-04-01
  ref <313>: RELEVANT RESIDUES IN SEQ ID NO: (1)..(1576)
tttacggagagtttgatcctggctcaggacaaacgctggcggcgtgcctaacacatgcaagtcgagcggtctttagcgagcggaatcttcggaggaagcgagttaaaggtagcggcggacgggtgagtaacgcgtgggcaatctacccttcaggccgggataacaccgggaaactggtgctaataccggatacggtctccgggaggcatcttctggagaagaaaggtggcgcaagctaccgctgaaggatgagcccgcgtcccattagctagttggtgaggtaacggcccaccaaggcgacgatgggtagccggcctgagagggtggccggccacactgggactgagacacggcccagactcctacgggaggcagcagtggggaatcttgcgcaatgggggaaaccctgacgcagcaacgccgcgtgagcgatgaaggccttcgggttgtaaagctctgtcatcagggacgaagtcttaaaggcgaatagtctttaaggtgacggtacctgaggaggaagccccggctaactacgtgccagcagccgcggtaaaacgtagggggcgagcgttgtccggaattactgggcgtaaagggcgtgtaggcggtctggcaagtcagatgtgaaaaaccccggctcaaccgggggcatgcatttgaaactgtcaggcttgagggcaggagaggagagtggaattcccggtgtagcggtgaaatgcgtagatatcgggaggaacaccagtggcgaaggcgactctctggcctggccctgacgctgaggcgcgaaagcgtggggagcaaacaggattagataccctggtagtccacgccgtaaacgatgggtactaggtgtaggaggtatcgaccccttctgtgccgcagtaaacacaataagtaccccgcctggggagtacggccgcaaggctgaaactcaaaggaattgacgggggcccgcacaagcggtggagcatgtggtttaattcgacgcaacgcgaagaaccttaccggggtttgacatcctgcgaaccctttggaaacaagggggtgcccttcggggagcgcagagacaggtggtgcatggttgtcgtcagctcgtgtcgtgagatgttgggttaagtcccgcaacgagcgcaacccctacttttagttgccagcgggtaaagccgggcactctaaagggactgccggtgacaaaccggaggaaggtggggatgacgtcaaatcatcatgccccttatatcccgggctacacacgtgctacaatggcctgtacagagggaggcgaaggagcgatccggagcgaatcccaaaaagcaggtctaagttcggattgcaggctgcaactcgcctgcatgaagtcggaatcgctagtaatcgcggatcagcatgccgcggtgaatacgttcccgggccttgtacacaccgcccgtcacaccacgaaagctggcaacacccgaagccggtgcccgaacccgcgagggacggagccgtctaaggtggggctggtgattggggtgaagtcgtaacaaggtagccgtatcggaaggtgcggctggatcacctcctttctaaggag

SEQ ID NO: 667 - DNA, 1570 bp, Moorella stamsii
  ref <308>: DATABASE ACCESSION NUMBER: NCBI ACCESSION: NZ_PVXL01000051.1
  ref <309>: DATABASE ENTRY DATE: 2019-04-01
  ref <313>: RELEVANT RESIDUES IN SEQ ID NO: (1)..(1570)
tttacggagagtttgatcctggctcaggacaaacgctggcggcgtgcctaacacatgcaagtcgagcggtctttaccttgcggaatcttcggaggaagcgaggtaaagatagcggcggacgggtgagtaacgcgtgggtaatctacccttcagaccgggataacaccgggaaactggtgctaataccggatacgttctactggaggcatctccggtagaagaaaaggaaacgcgagtgaccgctgaaggatgagcccgcgtcccattagctagttggtgaggtaacggctcaccaaggcgacgatgggtagccggcctgagagggtggccggccacactgggactgagacacggcccagactcctacgggaggcagcagtggggaatcttgcgcaatgggcgaaagcctgacgcagcgacgccgcgtgagcgatgaaggccttcgggttgtaaagctctgtcatcagggacgaagtctctggataagaggtgacggtacctgaggaggaagccccggctaactacgtgccagcagccgcggtaaaacgtagggggcgagcgttgtccggaattactgggcgtaaagggcgtgtaggcggcccggcaagtcagatgtgaaaaacccaggctcaacctggggggtgcatttgaaactggcgggcttgagggcaggagaggagagtggaattcccggtgtagcggtgaaatgcgtagatatcgggaggaacaccagtggcgaaggcgactctctggactgaccctgacgctgaggcgcgaaagcgtggggagcaaacaggattagataccctggtagtccacgccgtaaacgatgggtactaggtgttggaggtatcgacccctccagtgccgcagttaacacaataagtaccccgcctggggagtacggccgcaaggctgaaactcaaaggaattgacgggggcccgcacaagcggtggagcatgtggtttaattcgacgcaacgcgaagaaccttaccggggtttgacatcccgcgaacctggtggaaacaccggggtgccggttttaccggagcgcggagacaggtggtgcatggttgtcgtcagctcgtgtcgtgagatgttgggttaagtcccgcaacgagcgcaacccctacctttagttgccagcacgtaaaggtgggcactctaaagggactgccggtgacaaaccggaggaaggtggggatgacgtcaaatcatcatgccccttatatcccgggctacacacgtgctacaatggcctgtacaaaggggggcgaacccgcgagggggagcaaatcccaaaaagcaggtctcagttcggattgcaggctgcaactcgcctgcatgaagtcggaatcgctagtaatcgcggatcagcatgccgcggtgaatacgttcccgggccttgtacacaccgcccgtcacaccacgaaagctggcaacacccgaagccggtgacccaacctgcaaaggagggagccgtcgaaggtggggctggtgattggggtgaagtcgtaacaaggtagccgtatcggaaggtgcggctggatcacctcctttctaaggag

SEQ ID NO: 668 - DNA, 1192 bp, Oceanobacillus arenosus
  ref <308>: DATABASE ACCESSION NUMBER: NCBI ACCESSION: NZ_PIOC01000034.1
  ref <309>: DATABASE ENTRY DATE: 2019-04-01
  ref <313>: RELEVANT RESIDUES IN SEQ ID NO: (1)..(1192)
ggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatgatagtaactgatcataccttgacggtacctaaccagaaagccacggctaactacgtgccagcagccgcggtaatacgtaggtggcaagcgttgtccggaattattgggcgtaaagcgctcgcaggcggtcttttaagtctgatgtgaaatctcgtggcttaaccacgaacggtcattggaaactgggggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatccttttgccctccctagagatagggatttcccttcggggacaaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggctgcaaaaccgcgaggtcaagcaaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtcggtaacacccgaagtcggtgaggtaac

SEQ ID NO: 669 - DNA, 1468 bp, Oceanobacillus bengalensis
  ref <308>: DATABASE ACCESSION NUMBER: NCBI ACCESSION: NZ_RBZO01000079.1
  ref <309>: DATABASE ENTRY DATE: 2019-04-01
  ref <313>: RELEVANT RESIDUES IN SEQ ID NO: (1)..(1468)
cgcttgtggaacgagcggcggacgggtgagtaacacgtgggcaacctacctataagactgggataactcgcggaaacgtgagctaatacctgataatactttttatcgcatgatggaaagttcaaaggcggcgcaagctgtcacttatagatgggcccgcggcgcattagctagttggtggggtaaaggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgagatagtaactgatctcgccttgacggtacctaaccagaaagccacggctaactacgtgccagcagccgcggtaatacgtaggtggcaagcgttgtccggatttattgggcgtaaagcgctcgcaggcggtcttttaagtctgatgtgaaatctcgcggctcaaccgtgagcggtcattggaaactggaggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacaatcctagagataggactttcccttcggggacagagtgacaggtggtgcatggttgtcgtcagctcgtgtcgtgagatgttgggttaagtcccgcaacgagcgcaacccttgagattagttgccagcatttagttgggcactctaatctgactgccggtgacaaaccggaggaaggtggggatgacgtcaaatcatcatgccccttatgacctgggctacacacgtgctacaatggatggtacaaagggcagcaaaaccgcgaggtcaagctaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 670 - DNA, 1464 bp, Oceanobacillus chungangensis
  ref <308>: DATABASE ACCESSION NUMBER: NCBI ACCESSION: NZ_PIOD01000028.1
  ref <309>: DATABASE ENTRY DATE: 2019-04-01
  ref <313>: RELEVANT RESIDUES IN SEQ ID NO: (1)..(1464)
gtggaatgagcggcggacgggtgagtaacacgtgggcaacctacctgtaagatcgggataactcgcggaaacgtgagctaataccggataacacttttcgcctcatggtgagaagatgaaaggcggcgcaagctgtcacttacagatgggcccgcggcgcattagctagttggtggggtaaaggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatgatagtaactgatcataccttgacggtacctaaccagaaagccacggctaactacgtgccagcagccgcggtaatacgtaggtggcaagcgttgtccggaattattgggcgtaaagcgctcgcaggcggtcttttaagtctgatgtgaaatctcgtggcttaaccacgaacggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatccttttgccctccctagagatagggatttcccttcggggacaaaagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggctgcaaaaccgcgaggtcaagcaaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtcggtaacacccgaagtcggtgaggtaaccatttggagccagccgccgaaggtgggaccaatgattggggtgaagtcgtaacaaggtagccgtatcggaaggtgcggctggatcacctcctttct

SEQ ID NO: 671 - DNA, 1570 bp, Oceanobacillus halophilus
  ref <308>: DATABASE ACCESSION NUMBER: NCBI ACCESSION: NZ_RBZP01000047.1
  ref <309>: DATABASE ENTRY DATE: 2019-04-01
  ref <313>: RELEVANT RESIDUES IN SEQ ID NO: (1)..(1570)
tttttggagagtttgatcttggctcaggacgaacgctggcggcgtgcctaatacatgcaagtcgagcgcgggaagctaactgatctccttcgggagtgacgttagtggaacgagcggcggacgggtgagtaacacgtgggcaacctgcctgtaagactgggataacttgcggaaacgtgagctaataccggataatacttttcatctcctgatgagaagattgaaagatggcttttagctgtcacttacagatgggcccgcggcgcattagctagttggtgaggtaaaggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagttggggagtaactgccccaaccttgacggtacctaaccagaaagccacggctaactacgtgccagcagccgcggtaatacgtaggtggcaagcgttgtccggatttattgggcgtaaagcgctcgcaggcggtcttttaagtctgatgtgaaatcttgcggctcaaccgcaagcggtcattggaaactgggggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacactcctagagataggattttcccttcggggacagagtgacaggtggtgcatggttgtcgtcagctcgtgtcgtgagatgttgggttaagtcccgcaacgagcgcaacccttgatcttagttgccagcattcagttgggcactctaggatgactgccggtgacaaaccggaggaaggtggggatgacgtcaaatcatcatgccccttatgacctgggctacacacgtgctacaatggatggtacaaagggaagcgaaaccgcgaggtcaagcaaatcccataaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaacctttttggagccagccgccgaaggtgggaccaatgattggggtgaagtcgtaacaaggtagccgtatcggaaggtgcggctggatcacctcctttcta

SEQ ID NO: 672 - DNA, 1070 bp, Oceanobacillus limi
  ref <308>: DATABASE ACCESSION NUMBER: NCBI ACCESSION: NZ_FOHE01000051.1
  ref <309>: DATABASE ENTRY DATE: 2019-04-01
  ref <313>: RELEVANT RESIDUES IN SEQ ID NO: (1)..(1070)
ccttgacggtacctaaccagaaagccccggctaactacgtgccagcagccgcggtaatacgtagggggcaagcgttgtccggaattattgggcgtaaagcgcgcgtaggcggtcctttaagtctgatgtgaaagcccacggcttaaccgtggagggtcattggaaactggaggacttgagtgcagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaacgctctagagatagagtttccccttcgggggcagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggcagcgaagccgcgaggccaagcaaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgcctaaggtgggaccaatgattggggtgaagtcgtaacaaggtagccgtatcggaaggtgcggctggatcacctcctttctaa

SEQ ID NO: 673 - DNA, 1567 bp, Oceanobacillus picturae
  ref <308>: DATABASE ACCESSION NUMBER: NCBI ACCESSION: NZ_QWLU01000033.1
  ref <309>: DATABASE ENTRY DATE: 2019-04-01
  ref <313>: RELEVANT RESIDUES IN SEQ ID NO: (1)..(1567)
tttttggagagtttgatcttggctcaggacgaacgctggcggcgtgcctaatacatgcaagtcgagcgcaggaagcaagttgatccccttcgggggtgacgcttgtggaatgagcggcggacgggtgagtaacacgtgggcaacctgcctgtaagactgggataaccccgggaaaccggggctaataccggataatactttcttttgcataaaggaaagttgaaaggcggcttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagttgggtagtaactgacccaaccttgacggtacctaaccagaaagccacggctaactacgtgccagcagccgcggtaatacgtaggtggcaagcgttgtccggaattattgggcgtaaagcgctcgcaggcggtcctttaagtctgatgtgaaatctcgcggctcaaccgcgaacggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgctattcctagagataggaagttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggaagcaaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 674 - DNA, 1469 bp, Oceanobacillus profundus
  ref <308>: DATABASE ACCESSION NUMBER: NCBI ACCESSION: NZ_QWEH01000053.1
  ref <309>: DATABASE ENTRY DATE: 2019-04-01
  ref <313>: RELEVANT RESIDUES IN SEQ ID NO: (1)..(1469)
atgtttatggaatgagcggcggacgggtgagtaacacgtgggcaacctgcctgtaagatcgggataactcgcggaaacgtgagctaataccggataacacttttcatctcatggtgagaagataaaagacggtttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagttgggtagtaactgacccaaccttgacggtacctaaccagaaagccacggctaactacgtgccagcagccgcggtaatacgtaggtggcaagcgttgtccggaattattgggcgtaaagcgctcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgatacctctagagatagagttttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggaagcgaacccgtgaggtcaagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggactaatgattggggtgaagtcgtaacaaggtagccgtatcggaaggtgcggctggatcacctcctttcta

SEQ ID NO: 675 - DNA, 229 bp, Oceanobacillus rekensis
  ref <308>: DATABASE ACCESSION NUMBER: NCBI ACCESSION: NZ_MTBQ01000003.1
  ref <309>: DATABASE ENTRY DATE: 2019-04-01
  ref <313>: RELEVANT RESIDUES IN SEQ ID NO: (1)..(229)
tttatggagagtttgatcttggctcaggacgaacgctggcggcgtgcctaatacatgcaagtcgagcgcgggaagcaagtgatcacccttcggggtgtgaacttgtggaacgagcggcggacgggtgagtaacacgtgggcaacctgcctgtaagatcgggataactcgcggaaacgtgagctaataccggataatactttttaactcctgttggaaagttaaaagacg

SEQ ID NO: 676 - DNA, 1572 bp, Oceanobacillus sp. 160
  ref <308>: DATABASE ACCESSION NUMBER: NCBI ACCESSION: NZ_CP024848.1
  ref <309>: DATABASE ENTRY DATE: 2019-04-01
  ref <313>: RELEVANT RESIDUES IN SEQ ID NO: (1)..(1572)
tttattggagagtttgatcttggctcaggacgaacgctggcggcgtgcctaatacatgcaagtcgagcgcaggaagcttttccgatcccttcggggtgaagaagagtggaatgagcggcggacgggtgagtaacacgtgggcaacctacctgtaagatcgggataactcgcggaaacgtgagctaataccggataacacttttcacctcatggtgagaagatgaaaggcggcgtaagctgtcacttacagatgggcccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatgatagtaactgatcataccttgacggtacctaaccagaaagccacggctaactacgtgccagcagccgcggtaatacgtaggtggcaagcgttgtccggaattattgggcgtaaagcgctcgcaggcggtcttttaagtctgatgtgaaatctcgtggcttaaccacgaacggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatccttttgccctccctagagatagggatttcccttcggggacaaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggctgcaaaaccgcgaggtcaagcaaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtcggtaacacccgaagtcggtgaggtaacgcaatatgcgagccagccgccgaaggtgggaccaatgattggggtgaagtcgtaacaaggtagccgtatcggaaggtgcggctggatcacctcctttct

SEQ ID NO: 677 - DNA, 1352 bp, Oceanobacillus sp. YLB-02
  ref <308>: DATABASE ACCESSION NUMBER: NCBI ACCESSION: NZ_RCHR01000018.1
  ref <309>: DATABASE ENTRY DATE: 2019-04-01
  ref <313>: RELEVANT RESIDUES IN SEQ ID NO: (1)..(1352)
gaaaatgaaaggcggcgtaagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtgaggtagtaactgccctcaccttgacggtacctaaccagaaagccacggctaactacgtgccagcagccgcggtaatacgtaggtggcaagcgttgtccggatttattgggcgtaaagcgctcgcaggcggtcttttaagtctgatgtgaaatctcgcggctcaaccgcgaacggtcattggaaactggaggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacacccctagagatagggctttcccttcggggacagagtgacaggtggtgcatggttgtcgtcagctcgtgtcgtgagatgttgggttaagtcccgcaacgagcgcaacccttgaaattagttgccagcatttagttgggcactctagtttgactgccggtgacaaaccggaggaaggtggggatgacgtcaaatcatcatgccccttatgacctgggctacacacgtgctacaatggatggtacaaagggaagcgaaactgtgaagtcgagcaaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 678 - DNA, 1551 bp, Orenia metallireducens
  ref <308>: DATABASE ACCESSION NUMBER: NCBI ACCESSION: NZ_OBDZ01000079.1
  ref <309>: DATABASE ENTRY DATE: 2019-04-01
  ref <313>: RELEVANT RESIDUES IN SEQ ID NO: (1)..(1551)
tttattggagagtttgatcctggctcaggacgaacgctggcggcgtgcttaacacatgcaagttgaacgcgaaagttttcttcggaaaattagtagagtagcggacgggtgagtaacgcgtgggtaatctacctttaagttaggaataacttctcgaaagagaagctaatacctaataatctcttacgagcaaagatggcttcttcttagctatcgcttaaagatgagcctgcgtcccattagcttgttggtgaggtaaaagctcaccaaggcaacaatgggtagccgacctgagagggtgatcggccacactgggactgagacacggcccagactcctacgggaggctgcagtggggaatcttccgcaatggacgaaagtctgacggagcaacgccgcgtgaacgatgaaggccttcgggtcgtaaagttctgtcctttgggaagaatactttagttactaatactagctagagttgacggtacctttggaggaagctctggctaactacgtgccagcagccgcggtaatacgtagagagcaagcgttgtccggaatcattgggcgtaaagggtacgcaggcggtctattaagtcagaggtgaaatccaacagctcaactgttgaactgcctttgatactggtagacttgaggataagagaagaaaacggaattcctagtgtagcggtgaaatgcgtagatattaggaagaataccgatggcgaaagcagttttctaacttattcctgacgctcaggtacgaaagctagggtagcaaacgggattagataccccggtagtcctagccgtaaacgatggatactaggtgttgggggttcgaccccctcggtgccgcagttaacgcattaagtatcccgcctggggattacgaccgcaaggttgaaactcaaaggaattgacggggacccgcacaagcggtggagcatgtggtttaattcgatgcaacgcgaagaaccttaccagaacttgacatccctgtgactatctcttaatcgagagtcttcccttttgggaacacaggtgacaggtggtgcatggctgtcgtcagctcgtgtcgtgagatgttgggttaagtcccgtaacgagcgcaacccctatccttagttgccagcacgtaatggtggggactctaaggagactgccgcggaaaaacgcggaggaaggtggggatgacgtcaagtcatcatgccccttatgttctgggctacacacgtgctacaatggcttatacagagggttgctacatcgtgagatgatgctaatctctaaagtaagtctcagttcggattgcaggctgcaactcgcctgcatgaagctggaatcgctagtaatcgtggatcagaatgccacggtgaatacgttcccgggtcttgtacacaccgcccgtcacaccacccgagtcgggggcaccagaagtcgtcggcctaacttttagaaggagacgccgaaggtgcgttcggtaaggggggtgaagtcgtaacaaggtagccgtaccggaaggtgcggctggatcacctcctttctaaggag

SEQ ID NO: 679 - DNA, 1145 bp, Paenibacillus aceti
  ref <308>: DATABASE ACCESSION NUMBER: NCBI ACCESSION: NZ_KZ987724.1
  ref <309>: DATABASE ENTRY DATE: 2019-04-01
  ref <313>: RELEVANT RESIDUES IN SEQ ID NO: (1)..(1145)
tttattggagagtttgatcctggctcaggacgaacgctggcggcgtgcctaatacatgcaagtcgagcggacttgatggagagcttgctctccggagagttagcggcggacgggtgagtaacacgtaggtaacctgcctgtaagactgggataactagcggaaacgttagctaataccggataatttattttctcgcatggggaagtaatgaaagacggagcaatctgtcacttgcagatggacctgcggcgcattagctagttggtggggtaacggctcaccaaggcgacgatgcgtagccgacctgagagggtgaacggccacactaggactgagacacggcccagactcctacgggaggcagcagtagggaatcttccgcaatggacgaaagtctgacggagcaacgccgcgtgagtgatgaaggttttcggatcgtaaagctctgttgccagggaagaacgttcggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctgatgtttaatcctgaggctcaaccttaggtcgcattggaaactgggtagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgacgggtacagagatgtacctttccttcgggacagaggagacaggtggtgcatggttgtcgtcagctcgtgtcgtgagatgttgggttaagtcccgcaacgagcgcaacccttgattttagttgccagcac

SEQ ID NO: 680 - DNA, 1072 bp, Paenibacillus agaridevorans
  ref <308>: DATABASE ACCESSION NUMBER: NCBI ACCESSION: NZ_BDQX01000123.1
  ref <309>: DATABASE ENTRY DATE: 2019-04-01
  ref <313>: RELEVANT RESIDUES IN SEQ ID NO: (1)..(1072)
gacggtacctgagaagaaagccccggctaactacgtgccagcagccgcggtaatacgtagggggcaagcgttgtccggaattattgggcgtaaagcgcgcgcaggcggttcattaagtctggtgtttaaggctggggctcaaccctggttcgcactggaaactggtggacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggctttccttcgggacagaggagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccagtacaacgggaagcgaactcgcgagagggagccaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaagga

SEQ ID NO: 681 - DNA, 1550 bp, Paenibacillus alginolyticus
  ref <308>: DATABASE ACCESSION NUMBER: NCBI ACCESSION: NZ_BILU01000256.1
  ref <309>: DATABASE ENTRY DATE: 2019-04-01
  ref <313>: RELEVANT RESIDUES IN SEQ ID NO: (1)..(1550)
ttatggagagtttgatcctggctcaggacgaacgctggcggcgtgcctaatacatgcaagtcgagcgggtttacccttcggggtaagctagcggcggacgggtgagtaacacgtaggtaacctgcctataagatcgggataactatcggaaacgatagctaagaccggataattggttttctcgcatgagagaattatgaaacacggagcaatctgtggcttatagatgggcctgcggcgcattagctagttggtagggtaacggcctaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcaaggagagtaactgctctttgtgtgacggtataggagaagaaagccccggctaactacgtgccagcagccgcggtaatacgtagggggcaagcgttgtccggaattattgggcgtaaagcgcgcgcaggcggtcaattaagttgggtgtttaagcccggggctcaaccccggttcgcatccaaaactggttgacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatactaggtgttggggattcgattcctcggtgccgaagttaacacagtaagtatgccgcctggggagtacgctcgcaagagtgaaactcaaaggaattgacggggacccgcacaagcagtggagtatgtggtttaattcgaagcaacgcgaagaaccttaccaggtcttgacatctgggtgtaagcactagagatagtgcccctcttcggagcacccaagacaggtggtgcatggttgtcgtcagctcgtgtcgtgagatgttgggttaagtcccgcaacgagcgcaacccttgatcttagttgccagcactttgggtgggcactctaagatgactgccggtgacaaaccggaggaaggtggggatgacgtcaaatcatcatgccccttatgacctgggctacacacgtactacaatggtcggtacaacgggaagcgaagccgcgaggtggagccaatccttacaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 682 - DNA, 1248 bp, Paenibacillus amylolyticus
  ref <308>: DATABASE ACCESSION NUMBER: NCBI ACCESSION: NZ_FMIS01000040.1
  ref <309>: DATABASE ENTRY DATE: 2019-04-01
  ref <313>: RELEVANT RESIDUES IN SEQ ID NO: (1)..(1248)
gatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccgatacagagatgtatctttccttcgggacagaggagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 683 - DNA, 1535 bp, Paenibacillus anaericanus
  ref <308>: DATABASE ACCESSION NUMBER: NCBI ACCESSION: NZ_RZNY01000080.1
  ref <309>: DATABASE ENTRY DATE: 2019-04-01
  ref <313>: RELEVANT RESIDUES IN SEQ ID NO: (1)..(1535)
gacgaacgctggcggcgtgcctaatacatgcaagtcgagcggagttgatgaggtgcttgcacctctgatacttagcggcggacgggtgagtaacacgtaggtaacctgcccgtaagactgggataactaccggaaacggtagctaataccggataatttattttctcgcatgagagaataatgaaaggcggagcaatctgccacttacggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggtcatttaagtctggtgtttaatcctggggctcaaccccgggtcgcactggaaactgggtggcttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatcccgatgcaaactctagagatagagtccttcttcggaacattggagacaggtggtgcatggttgtcgtcagctcgtgtcgtgagatgttgggttaagtcccgcaacgagcgcaacccttgatcttagttgccagcaggttaagctgggcactctaaggtgactgccggtgacaaaccggaggaaggtggggatgacgtcaaatcatcatgccccttatgacctgggctacacacgtactacaatggctggtacaacgggaagcgaaaccgcgaggtggagcgaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 684 - DNA, 1370 bp, Paenibacillus antibioticophila
  ref <308>: DATABASE ACCESSION NUMBER: NCBI ACCESSION: NZ_HG005147.1
  ref <309>: DATABASE ENTRY DATE: 2019-04-01
  ref <313>: RELEVANT RESIDUES IN SEQ ID NO: (1)..(1370)
ccgcatggggaggtaatgaaaggcggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgaagaaggttttcggatcgtaaagctctgttgccagggaagaacgtctttgggagtaactgcccaaggagtgacggtacctgagaagaaagccccggctaactacgtgccagcagccgcggtaatacgtagggggcaagcgttgtccggaattattgggcgtaaagcgcgcgcaggcggttgtttaagtctggtgtttaaaccatgggctcaactcatggtcgcactggaaactgggcaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtgcctttccttcgggacattcaagacaggtggtgcatggttgtcgtcagctcgtgtcgtgagatgttgggttaagtcccgcaacgagcgcaacccttaactttagttgccagcaggtaaagctgggcactctagagtgactgccggtgacaaaccggaggaaggtggggatgacgtcaaatcatcatgccccttatgacctgggctacacacgtactacaatggccggtacaacgggaagcgaaggagcgatctggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggag

SEQ ID NO: 685 - DNA, 1353 bp, Paenibacillus apiarius
  ref <308>: DATABASE ACCESSION NUMBER: NCBI ACCESSION: NZ_NDGJ01000008.1
  ref <309>: DATABASE ENTRY DATE: 2019-04-01
  ref <313>: RELEVANT RESIDUES IN SEQ ID NO: (1)..(1353)
atgggaaagacggagcaatctgtcacttgcagatggacctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgccagggagagtaactgctctctgggtgacggtacctgagaagaaagccccggctaactacgtgccagcagccgcggtaatacgtagggggcaagcgttgtccggaattattgggcgtaaagcgcgcgcaggcggtgatgtaagttgggtgtttaaacctagggctcaaccttgggtcgcatccaaaactgcatgacttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggcttcccttcggggcagaggagacaggtggtgcatggttgtcgtcagctcgtgtcgtgagatgttgggttaagtcccgcaacgagcgcaacccttaactttagttgccagcattgagttgggcactctagagtgactgccggtgacaaaccggaggaaggtggggatgacgtcaaatcatcatgccccttatgacctgggctacacacgtactacaatggctggtacaacgggaagcgaagccgcgaggtgaagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctaagga

SEQ ID NO: 686 - DNA, 1462 bp, Paenibacillus aquistagni
  ref <308>: DATABASE ACCESSION NUMBER: NCBI ACCESSION: NZ_FXAZ01000018.1
  ref <309>: DATABASE ENTRY DATE: 2019-04-01
  ref <313>: RELEVANT RESIDUES IN SEQ ID NO: (1)..(1462)
gcttagcggcggacgggtgagtaacacgtaggtaacctgcccataagactgggataacccacggaaacgtgagctaataccagataggcatcttcttcgcatgaaggagatgagaaagacggtttcggctgtcacttatggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgctcaggagagtaactgctcttgaggtgacggtacttgagaagaaagccccggctaactacgtgccagcagccgcggtaatacgtagggggcaagcgttgtccggaattattgggcgtaaagcgcgcgcaggcggcgatgtaagttgggtgtttaaacctagggctcaaccttgggtcgcacccaaaactgcatggcttgagtgcagcagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccgtcctagagataggactttccttcgggacattcaagacaggtggtgcatggttgtcgtcagctcgtgtcgtgagatgttgggttaagtcccgcaacgagcgcaacccttaactttagttgccagcattaagttgggcactctagagtgactgccggtgacaaaccggaggaaggtggggatgacgtcaaatcatcatgccccttatgacctgggctacacacgtactacaatggtcggtacaacgggaagcgaagccgcgaggtggagccaatcctaaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctaagga

SEQ ID NO: 687 - DNA, 1561 bp, Paenibacillus baekrokdamisoli
  ref <308>: DATABASE ACCESSION NUMBER: NCBI ACCESSION: NZ_AP019308.1
  ref <309>: DATABASE ENTRY DATE: 2019-04-01
  ref <313>: RELEVANT RESIDUES IN SEQ ID NO: (1)..(1561)
ttatggagagtttgatcctggctcaggacgaacgctggcggcgtgcctaatacatgcaagtcgagcggatttaagaggaagcttgcttccgattaaattagcggcggacgggtgagtaacacgtaggcaacctgcctacaagatcgggataacattcggaaacgaatgctaataccggatacacaatttggctgcatggccgaattgggaaaggcggagcaatctgccgcttgtagatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttctcggatcgtaaagctctgttgccagggaagaacagcgaggagagtaactgctcctcgtgtgacggtacctgagaagaaagccccggctaactacgtgccagcagccgcggtaatacgtagggggcaagcgttgtccggaattattgggcgtaaagcgcgcgcaggcggccttgtaagtctagtgtttaatctcggagctcaactccgattcgcactggaaactgcaaagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccagctcttgacatcccgatgtaagcattagagatagtgcccctcttcggagcatcggagacaggtggtgcatggttgtcgtcagctcgtgtcgtgagatgttgggttaagtcccgcaacgagcgcaacccttgatcttagttgccagcaggttaagctgggcactctaaggtgactgccggtgacaaaccggaggaaggtggggatgacgtcaaatcatcatgccccttatgagctgggctacacacgtactacaatggccggtacaacgggcagcgataccgcgaggtggagcgaatccttaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaagga

SEQ ID NO: 688 - DNA, 1488 bp, Paenibacillus barcinonensis
  ref <308>: DATABASE ACCESSION NUMBER: NCBI ACCESSION: NZ_QJSW01000063.1
  ref <309>: DATABASE ENTRY DATE: 2019-04-01
  ref <313>: RELEVANT RESIDUES IN SEQ ID NO: (1)..(1488)
gagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgggtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 689 - DNA, 1569 bp, Paenibacillus bouchesdurhonensis
  ref <308>: DATABASE ACCESSION NUMBER: NCBI ACCESSION: NZ_LT732548.1
  ref <309>: DATABASE ENTRY DATE: 2019-04-01
  ref <313>: RELEVANT RESIDUES IN SEQ ID NO: (1)..(1569)
aatcctttaatggagagtttgatcctggctcaggacgaacgctggcggcgtgcctaatacatgcaagtcgagcgaagttgttttggaagcttgcttccgaaataacttagcggcggacgggtgagtaatacgtaggcaacctgcccctcagcctgggataactagcggaaacgttagctaataccggataatttgctttttcgcatgaagaagcaatgaaagacggagcaatctgtcactaagggatgggcctacggcgcattagctagttggtgaggtaatggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgtcttagagagtaactgctctaagagtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaactccgggtcgcactggaaactgggtggcttgagtgcagaagaggagagtggaattccacgtgtagcggtgaaatgcgtagagatgtggaggaacaccagtggcgaaggcgactctctgggctgtaactgacgctgaggcgcgaaagcgtgggtagcaaacaggattagataccctggtagtccacgccgtaaacgatgaatgctaggtgttaggggtttcgatacccttggtgccgaagtaaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtgcctttccttcgggacagaggagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgccctgggctacacacgtactacaatggccagtacaacgggaagcgaagccgcgaggtggagcgaatccaatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggag

SEQ ID NO: 690 - DNA, 1566 bp, Paenibacillus bovis
  ref <308>: DATABASE ACCESSION NUMBER: NCBI ACCESSION: NZ_CP013023.1
  ref <309>: DATABASE ENTRY DATE: 2019-04-01
  ref <313>: RELEVANT RESIDUES IN SEQ ID NO: (1)..(1566)
cttttatggagagtttgatcctggctcaggacgaacgctggcggcgtgcctaatacatgcaagtcgagcggagttgatagagtgcttgcactcttgagacttagcggcggacgggtgagtaacacgtaggcaacctgcccctcagactgggataactaccggaaacggtagctaataccggataatcgttttcttctcctgaagagaccgggaaagacggagcaatctgtcactggaggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcttctagagtaactgctagaagagtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccgaagctcaacttcgggtcgcatcggaaactggatgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtaccttttcttcggaacattcaagacaggtggtgcatggttgtcgtcagctcgtgtcgtgagatgttgggttaagtcccgcaacgagcgcaacccttatgcttagttgccagcacatcatggtgggcactctaagcagactgccggtgacaaaccggaggaaggtggggatgacgtcaaatcatcatgccccttatgacctgggctacacacgtactacaatggtcggtacaacgggaagcgaagccgcgaggtggagcgaatcctaaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 691 - DNA, 1563 bp, Paenibacillus campinasensis
  ref <308>: DATABASE ACCESSION NUMBER: NCBI ACCESSION: NZ_NPBY01000122.1
  ref <309>: DATABASE ENTRY DATE: 2019-04-01
  ref <313>: RELEVANT RESIDUES IN SEQ ID NO: (1)..(1563)
tttattggagagtttgatcctggctcaggacgaacgctggcggcgtgcctaatacatgcaagtcgagcggaatcgatggagtgcttgcactcctgagatttagcggcggacgggtgagtaacacgtaggcaacctgccctcaagactgggataactaccggaaacggtagctaataccggataggatatttggctgcatggccgaatatggaaaggcggagcaatctgtcacttgaggatgggcctgcggcgcattagctagttggtggggtaatggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgccagagagagtaactgctctttgggtgacggtacctgagaagaaagccccggctaactacgtgccagcagccgcggtaatacgtagggggcaagcgttgtccggaattattgggcgtaaagcgcgcgcaggcggttctttaagtctggtgtttaaacccggagcttaacttcgggacgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgacccctctagagatagaggtttccttcgggacagaggagacaggtggtgcatggttgtcgtcagctcgtgtcgtgagatgttgggttaagtcccgcaacgagcgcaacccttgatcttagttgccagcacgtaatggtgggcactctaaggtgactgccggtgacaaaccggaggaaggtggggatgacgtcaaatcatcatgccccttatgacctgggctacacacgtactacaatggctggtacaacgggaagcgaagccgcgaggtggagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctggatcacctcctttctatggaga

SEQ ID NO: 692 - DNA, 1559 bp, Paenibacillus castaneae
  ref <308>: DATABASE ACCESSION NUMBER: NCBI ACCESSION: NZ_KZ614144.1
  ref <309>: DATABASE ENTRY DATE: 2019-04-01
  ref <313>: RELEVANT RESIDUES IN SEQ ID NO: (1)..(1559)
ttggagagtttgatcctggctcaggacgaacgctggcggcgtgcctaatacatgcaagtcgagcggagttgaagaggtgcttgcacctctgatacttagcggcggacgggtgagtaacacgtgggtaacctgcctttaagactgggataacattcggaaacgaatgctaataccggatacgcgatatggtcgcatgactgaatcgggaaagatggagcaatctatcacttagagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaatgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggccttgtaagtctgttgtttaaactcggggctcaaccccgagtcgcaatggaaactgcaaagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggctttccttcgggacagaggagacaggtggtgcatggttgtcgtcagctcgtgtcgtgagatgttgggttaagtcccgcaacgagcgcaacccttgatcttagttgccagcacttcgggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacccgcaagggagctagccgtcgaaggtggggtagatgattggggtgaagtcgtaacaaggtagccgtatcggaaggtgcggctggatcacctcctttctaagga

SEQ ID NO: 693 - DNA, 1370 bp, Paenibacillus catalpae
  ref <308>: DATABASE ACCESSION NUMBER: NCBI ACCESSION: NZ_FOMT01000014.1
  ref <309>: DATABASE ENTRY DATE: 2019-04-01
  ref <313>: RELEVANT RESIDUES IN SEQ ID NO: (1)..(1370)
ggtcgcatggccgaatcgggaaaggcggagcaatctgccacttatggatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttacgagagtaactgctcgtaaggtgacggtacctgagaagaaagccccggctaactacgtgccagcagccgcggtaatacgtagggggcaagcgttgtccggaattattgggcgtaaagcgcgcgcaggcggccttgtaagtctgtcgtttaaactcggagctcaacttcgagtcgcgatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgatcgtcctagagatagggctttccttcgggacagaggagacaggtggtgcatggttgtcgtcagctcgtgtcgtgagatgttgggttaagtcccgcaacgagcgcaacccttgatcttagttgccagcactttgggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 694 - DNA, 1413 bp, Paenibacillus cellulosilyticus
  ref <308>: DATABASE ACCESSION NUMBER: NCBI ACCESSION: NZ_QGTQ01000070.1
  ref <309>: DATABASE ENTRY DATE: 2019-04-01
  ref <313>: RELEVANT RESIDUES IN SEQ ID NO: (1)..(1413)
gggataacattcggaaacgaatgctaataccggataatcgatttcctcgcatggggagatcgggaaagacggagcaatctgtcacctgtggatgggcctgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaagctctgttgccagggaagaacacttgggagagtaactgctcctaaggtgacggtacctgagaagaaagccccggctaactacgtgccagcagccgcggtaatacgtagggggcaagcgttgtccggaattattgggcgtaaagcgcgcgcaggcggctttgtaagtctgtcgtttaagttcggggctcaaccccgtatcgcgatggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccaggtcttgacatccctctgaccggtctggagacaggccttcccttcggggcagaggagacaggtggtgcatggttgtcgtcagctcgtgtcgtgagatgttgggttaagtcccgcaacgagcgcaacccttgattttagttgccagcatctcggatgggcactctagaatgactgccggtgacaaaccggaggaaggcggggatgacgtcaaatcatcatgccccttatgacctgggctacacacgtactacaatggccggtacaacgggctgcgaaggagcgatccggagcgaatcctataaagccggtctcagttcggattggaggctgcaactcgcctccatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 695 - DNA, 1466 bp, Paenibacillus chibensis
  ref <308>: DATABASE ACCESSION NUMBER: NCBI ACCESSION: NZ_BIMK01000026.1
  ref <309>: DATABASE ENTRY DATE: 2019-04-01
  ref <313>: RELEVANT RESIDUES IN SEQ ID NO: (1)..(1466)
ttagcggcggacgggtgagtaacacgtaggtaacctgcctgtaagactgggataactaccggaaacggtagctaataccggataatttattttctctcctggggagataatgaaagacggagcaatctgtcacttacagatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcacttaagtctggtgtttaaggccaaggctcaaccttggttcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcacttcgggtgggcactctagaatgactgccggtgacaaaccggaggaaggcggggatgacgtcaaatcatcatgccccttatgacttgggctacacacgtactacaatggccagtacaacgggaagcgaagtcgcgagatggagccaatcctatcaaagctggtctcagttcggattgcaggctgcaacccgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 696 - DNA, 1564 bp, Paenibacillus chitinolyticus
  ref <308>: DATABASE ACCESSION NUMBER: NCBI ACCESSION: NZ_CP026520.1
  ref <309>: DATABASE ENTRY DATE: 2019-04-01
  ref <313>: RELEVANT RESIDUES IN SEQ ID NO: (1)..(1564)
tttatcggagagtttgatcctggctcaggacgaacgctggcggcgtgcctaatacatgcaagtcgagcggacttgatgagaagcttgcttctctgagagttagcggcggacgggtgagtaacacgtaggcaacctgcctgtaagatcgggataactaccggaaacggtagctaagaccggataaccggtttctccgcatggagagatcgtgaaacacggagcaatctgtggcttacggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgccaaggagagtaactgctctttgggtgacggtacctgagaagaaagccccggctaactacgtgccagcagccgcggtaatacgtagggggcaagcgttgtccggaattattgggcgtaaagcgcgcgcaggcggttttttaagtctggtgtttaatcccgaggctcaacctcggttcgcaccggaaactgggagactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgcatgctaggtgttaggggtttcgatacccttggtgccgaagttaacacagtaagcatgccgcctggggagtacgctcgcaagagtgaaactcaaaggaattgacggggacccgcacaagcagtggagtatgtggtttaattcgaagcaacgcgaagaaccttaccaggtcttgacatccctctgaccggcttagagataagcctttccttcgggacagaggtgacaggtggtgcatggttgtcgtcagctcgtgtcgtgagatgttgggttaagtcccgcaacgagcgcaacccttgaacttagttgccagcaggtgaagctgggcactctaagttgactgccggtgacaaaccggaggaaggcggggatgacgtcaaatcatcatgccccttatgacctgggctacacacgtactacaatggccggtacaacgggaagcgaagccgcgaggtggagccaatcctacaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggaga

SEQ ID NO: 697 - DNA, 1425 bp, Paenibacillus chondroitinus
  ref <308>: DATABASE ACCESSION NUMBER: NCBI ACCESSION: NZ_BILW01000106.1
  ref <309>: DATABASE ENTRY DATE: 2019-04-01
  ref <313>: RELEVANT RESIDUES IN SEQ ID NO: (1)..(1425)
ggcgtgcctaatacatgcaagtcgagcggagcacttcggtgcttagcggcggacgggtgagtaacacgtaggcaacctgcctataagactgggataactatcggaaacgatagctaagactggatagctggttttctcgcatgagaggatcatgaaacacggagcaatctgtggcttatagatgggactgcggcgcattagctagttggtagggtaacggcctaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcaaggtgagtaactgcactttgtgtgacggtataggagaagaaagccccggctaactacgtgccagcagccgcggtaatacgtagggggcaagcgttgtccggaattattgggcgtaaagcgcgcgcaggcggttaattaagttgggtgtttaagcccggggctcaaccccggttcgcatccaaaactggttgacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatactaggtgttggggattcgattcctcggtgccgaagttaacacagtaagtatgccgcctggggagtacgctcgcaagagtgaaactcaaaggaattgacggggacccgcacaagcagtggagtatgtggtttaattcgaagcaacgcgaagaaccttaccaggtcttgacatccctctgatcctagagataggggctcttcggaacaaggagacaggtggtgcatggttgtcgtcagctcgtgtcgtgagatgttgggttaagtcccgcaacgagcgcaacccttgatcttagttgccagcacttcgggtgggcactctaagatgactgccggtgacaaaccggaggaaggtggggatgacgtcaaatcatcatgccccttatgacctgggctacacacgtactacaatggtcggtacaacgggaagcgaagccgcgaggtggagccaatccttataagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggt

SEQ ID NO: 698 - DNA, 634 bp, Paenibacillus contaminans
  misc_feature (400)..(400): n is a, c, g, or t
  ref <308>: DATABASE ACCESSION NUMBER: NCBI ACCESSION: NZ_QMFB01000086.1
  ref <309>: DATABASE ENTRY DATE: 2019-04-01
  ref <313>: RELEVANT RESIDUES IN SEQ ID NO: (1)..(634)
agccgcggtaatacgtagggggcaagcgttgtccggaattattgggcgtaaagcgcgcgcaggcggtcttttaagttcggtgtttaaacccagggctcaaccttgggtcgcactggaaactgggagactggagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatgctaggtgttaggggtttcgatacccttggtgccgaagtaaacacattaagcatgccgcctggggagtacgctcgcaagagtgaaactcaaaggaattngccctccttcgggacatccaagacaggtggtgcatggttgtcgtcagctcgtgtcgtgagatgttgggttaagtcccgcaacgagcgcaacccttgatcttagttgccagcattgagttgggcactctaggatgactgccggtgacaaaccggaggaaggtggggatgacgtcaaatcatcatgccccttatgacctgggctacacacgtactacaatggccggtacaacgggc

SEQ ID NO: 699 - DNA, 1562 bp, Paenibacillus curdlanolyticus
  ref <308>: DATABASE ACCESSION NUMBER: NCBI ACCESSION: NZ_AEDD01000021.1
  ref <309>: DATABASE ENTRY DATE: 2019-04-01
  ref <313>: RELEVANT RESIDUES IN SEQ ID NO: (1)..(1562)
cttttatggagagtttgatcctggctcaggacgaacgctggcggcgtgcctaatacatgcaagtcgagcggacttgatggagtgcttgcactcctgaaagttagcggcggacgggtgagtaacacgtaggcaacctgcccgtaagactgggataacattcggaaacgaatgctaataccggataggcgattttctcgcatgagagaatcgggaaagaaggagcaatctttcacttacggatgggcctgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggctttcgggtcgtaaagctctgttgccagggaagaacacttgagagagtaactgctcttgagttgacggtacctgagaagaaagccccggctaactacgtgccagcagccgcggtaatacgtagggggcaagcgttgtccggaattattgggcgtaaagcgcgcgcaggcggctttgtaagtctgtcgtttaagttcggggctcaaccccgtgtcgcgatggaaactgcaaggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccaggtcttgacatccctctgaccgtcgcagagatgtgacttcccttcggggcagaggagacaggtggtgcatggttgtcgtcagctcgtgtcgtgagatgttgggttaagtcccgcaacgagcgcaacccttgattttagttgccagcactttaaggtgggcactctagaatgactgccggtgacaaaccggaggaaggcggggatgacgtcaaatcatcatgccccttatgacctgggctacacacgtactacaatggccggtacaacgggctgcgaaagagcgatctggagcgaatcctataaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 700 - DNA, 1560 bp, Paenibacillus dendritiformis
  ref <308>: DATABASE ACCESSION NUMBER: NCBI ACCESSION: NZ_QKVW01000109.1
  ref <309>: DATABASE ENTRY DATE: 2019-04-01
  ref <313>: RELEVANT RESIDUES IN SEQ ID NO: (1)..(1560)
cttttatggagagtttgatcctggctcaggacgaacgctggcggcgtgcctaatacatgcaagtcgagcggagcggatggagtgcttgcactcctgatgcttagcggcggacgggtgagtaatacgtaggtaacctgcccttaagaccgggataactcacggaaacgtgggctaataccggataggcgatttcctcgcatgagggaatcgggaaaggcggagcaatctgccacttatggatggacctacggcgcattagctagttggtggggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgctatggagagtaactgttccataggtgacggtacctgagaagaaagccccggctaactacgtgccagcagccgcggtaatacgtagggggcaagcgttgtccggaattattgggcgtaaagcgcgcgcaggcggtcatgtaagtctggtgtttaaacccggggctcaactccgggtcgcatcggaaactgtgtgacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggcttcccttcggggcagaggtgacaggtggtgcatggttgtcgtcagctcgtgtcgtgagatgttgggttaagtcccgcaacgagcgcaacccttaactttagttgccagcattgagttgggcactctagagtgactgccggtgacaaaccggaggaaggtggggatgacgtcaaatcatcatgccccttatgacctgggctacacacgtactacaatggctggtacaacgggaagcgaagccgcgaggtggagcgaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctggatcacctcctttctaagga

SEQ ID NO: 701 - DNA, 1565 bp, Paenibacillus donghaensis
  ref <308>: DATABASE ACCESSION NUMBER: NCBI ACCESSION: NZ_CP021780.1
  ref <309>: DATABASE ENTRY DATE: 2019-04-01
  ref <313>: RELEVANT RESIDUES IN SEQ ID NO: (1)..(1565)
tttggagagtttgatcctggctcaggacgaacgctggcggcatgcctaatacatgcaagtcgagcggagttttgttgaaagcttgctttcaacaggattcagcggcggacgggtgagtaacacgtaggcaacctgccccttagcctgggataactaccggaaacggtagctaataccggataattccttggttctcctgaaccgaggatgaaaggcggagcaatctgcccttaagggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctaaggtcgcactggaaactgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatctgctagagatagcagcggccttcgggacagaggagacaggtggtgcatggttgtcgtcagctcgtgtcgtgagatgttgggttaagtcccgcaacgagcgcaacccttatgcttagttgccagcacgtgatggtgggcactctaagcagactgccggtgacaaaccggaggaaggtggggatgacgtcaaatcatcatgccccttatgacctgggctacacacgtactacaatggccggtacaaagggctgcgaaaccgcgaggtggagcgaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagataattggggtgaagtcgtaacaaggtagccgtatcggaaggtgcggctggatcacctcctttctatggaga

SEQ ID NO: 702 - DNA, 1462 bp, Paenibacillus ehimensis
  ref <308>: DATABASE ACCESSION NUMBER: NCBI ACCESSION: NZ_BILX01000186.1
  ref <309>: DATABASE ENTRY DATE: 2019-04-01
  ref <313>: RELEVANT RESIDUES IN SEQ ID NO: (1)..(1462)
ggagcggcggacgggtgagtaacacgtaggcaacctgcctgtaagaccgggataactaccggaaacggtagctaagaccggataagtggtcttctcgcatgagaggatcaagaaacacggggtaacctgtggcttacagatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgtcgcggagagtaactgctctgcgaatgacggtacctgagaagaaagccccggctaactacgtgccagcagccgcggtaatacgtagggggcaagcgttgtccggaattattgggcgtaaagcgcgcgcaggcggccgcttaagtctggtgtttaagcccggggctcaaccccggttcgcactggaaactgggcggcttgagtgcaggagaggaaagcggaattccacgtgtagcggtgaaatgcgtagagatgtggaggaacaccagtggcgaaggcggctttctggcctgtaactgacgctgaggcgcgaaagcgtggggagcaaacaggattagataccctggtagtccacgccgtaaacgatgagtgctaggtgttaggggtttcgatacccttggtgccgaagtaaacacaataagcactccgcctggggagtacgctcgcaagagtgaaactcaaaggaattgacggggacccgcacaagcagtggagtatgtggtttaattcgaagcaacgcgaagaaccttaccaggtcttgacatccctctgaatatcctagagatagggtaggccttcgggacagaggagacaggtggtgcatggttgtcgtcagctcgtgtcgtgagatgttgggttaagtcccgcaacgagcgcaacccttgaacttagttgccagcattaagttgggcactctaagttgactgccggtgacaaaccggaggaaggtggggatgacgtcaaatcatcatgccccttatgacctgggctacacacgtactacaatggccggtacaacgggaagcgaagtcgcgagatggagccaatcctaagaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctggatcacctcctttctatggag

SEQ ID NO: 703 - DNA, 413 bp, Paenibacillus elgii
  ref <308>: DATABASE ACCESSION NUMBER: NCBI ACCESSION: NZ_FYEP01000093.1
  ref <309>: DATABASE ENTRY DATE: 2019-04-01
  ref <313>: RELEVANT RESIDUES IN SEQ ID NO: (1)..(413)
gtgccagccgccgcggtaatacagaggatgcaagcgttatccggaatgattgggcgtaaagcgtctgtaggtggctttttaagtccgccgtcaaatcccagggctcaactctggacaggcggtggaaactaccaagctggagtacggtaggggcagagggaatttccggtggagcggtgaaatgcgtagagatcggaaagaacaccaacggcgaaagcactctgctgggccgacactgacactgagagacgaaagctaggggagcgaatgggattagataccccagtagtcctagccgtaaacgatggatactaggcgctgtgcgtatcgacccgtgcagtgctgtagctaacgcgttaagtatcccgcctggggagtacgttcgcaagaatgaaacttaaaggaattgacgg

SEQ ID NO: 704 - DNA, 1523 bp, Paenibacillus ginsengarvi
  ref <308>: DATABASE ACCESSION NUMBER: NCBI ACCESSION: NZ_RBAH01000065.1
  ref <309>: DATABASE ENTRY DATE: 2019-04-01
  ref <313>: RELEVANT RESIDUES IN SEQ ID NO: (1)..(1523)
tggctcaggacgaacgctggcggcgtgcctaatacatgcaagtcgagcgaatccttcggggttagcggcggacgggtgagtaacacgtaggcaacctgcccgtaagtctgggataactatcggaaacgatagctaataccggatacgaagagagaacgcatgttctcttttggaaaggcggagcaatctgccacttacggatgggcctgcggcgcattagctagtaggcggggtaacggcccacctaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagagaagaacgccgaggagagtaactgctcttcgggtgacggtatctgagaagaaagccccggctaactacgtgccagcagccgcggtaatacgtagggggcaagcgttgtccggaattattgggcgtaaagcgcgcgcaggcggctgtttaagtctggtgtttaagcccggggctcaaccccggttcgcactggaaactggatggcttgagtgcaggagagggaagtggaattccacgtgtagcggtgaaatgcgtagagatgtggaggaacaccagtggcgaaggcgacttcctggcctgtaactgacgctgaggcgcgaaagcgtggggagcaaacaggattagataccctggtagtccacgccgtaaacgatgagtgctaggtgttaggggtttcgatacccttggtgccgaagtaaacacagtaagcactccgcctggggagtacggtcgcaagactgaaactcaaaggaattgacggggacccgcacaagcagtggagtatgtggtttaattcgaagcaacgcgaagaaccttaccaggtcttgacatccccctgaatatcctagagatagggtaggccttcgggacaggggagacaggtggtgcatggttgtcgtcagctcgtgtcgtgagatgttgggttaagtcccgcaacgagcgcaacccttgattttagttgccagcacttcgggtgggcactctagaatgactgccggtgacaaaccggaggaaggcggggatgacgtcaaatcatcatgccccttatgacctgggctacacacgtactacaatggccggtacaacgggccgcgaagccgcgaggtggagccaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggag

SEQ ID NO: 705 - DNA, 1224 bp, Paenibacillus glucanolyticus
  ref <308>: DATABASE ACCESSION NUMBER: NCBI ACCESSION: NZ_BIMC01000045.1
  ref <309>: DATABASE ENTRY DATE: 2019-04-01
  ref <313>: RELEVANT RESIDUES IN SEQ ID NO: (1)..(1224)
tttttggagagtttgatcctggctcaggacgaacgctggcggcgtgcctaatacatgcaagtcgagcggacttgaaggagtgcttgcactcctgagagttagcggcggacgggtgagtaacacgtaggcaacctgccctcaagactgggataactaccggaaacggtagctaataccggataatttattacatagcattatgtgataatgaaagacggagcaatctgtcacttggggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtctcatagagtaactgctatgagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacctggggctcaacttcaggtcgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatctgctagagatagcagcggccttcgggacagaggagacaggtggtgcatggttgtcgtcagctcgtgtcgtgagatgttgggttaagtcccgcaacgagcgcaacccttgattttagttgccagcaggtaaggctgggcactctagaatgactgccggtgacaaaccggaggaaggcggggatgacgtcaaatcatcatgcccctta

SEQ ID NO: 706 - DNA, 1344 bp, Paenibacillus glycanilyticus
  ref <308>: DATABASE ACCESSION NUMBER: NCBI ACCESSION: NZ_BILY01000086.1
  ref <309>: DATABASE ENTRY DATE: 2019-04-01
  ref <313>: RELEVANT RESIDUES IN SEQ ID NO: (1)..(1344)
ttaatggagagtttgatcctggctcaggacgaacgctggcggcgtgcctaatacatgcaagtcgagcggatcttgtccttcgggacaaggttagcggcggacgggtgagtaacacgtgggtaacctgcccataagactgggataacattcggaaacgaatgctaataccggatacgcgaatcggtcgcatgatcgaatcgggaaaggcggagcaatctgccacttatggatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttgcgagagtaactgctcgcaaggtgacggtacctgagaagaaagccccggctaactacgtgccagcagccgcggtaatacgtagggggcaagcgttgtccggaattattgggcgtaaagcgcgcgcaggcggccttgtaagtctgtcgtttaaactcggagctcaacttcgagtcgcgatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggctttccttcgggacagaggagacaggtggtgcatggttgtcgtcagctcgtgtcgtgagatgttgggttaagtcccgcaacgagcgcaacccttgatcttagttgccagcactttgggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaat

SEQ ID NO: 707 - DNA, 1566 bp, Paenibacillus herberti
  ref <308>: DATABASE ACCESSION NUMBER: NCBI ACCESSION: NZ_NMUQ01000002.1
  ref <309>: DATABASE ENTRY DATE: 2019-04-01
  ref <313>: RELEVANT RESIDUES IN SEQ ID NO: (1)..(1566)
cctttatggagagtttgatcctggctcaggacgaacgctggcggcgtgcctaatacatgcaagtcgagcggattgatgagggagcttgcttccgattcagttagcggcggacgggtgagtaacacgtaggcaacctgccctcaagactgggataaccttcggaaacggatgctaataccagataaacggtttctccacctggagagatcgagaaagacggagcaatctgttacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgccagggaagaacgggtagaggagtaactgcctttgccatgacggtacctgagaagaaagccccggctaactacgtgccagcagccgcggtaatacgtagggggcaagcgttgtccggaattattgggcgtaaagcgcgcgcaggcggctttgtaagtctggtgtttaatcttggggctcaaccccaagtcgcacgagaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacaataagcattccgcctggggagtacgctcgcaagagtgaaactcaaaggaattgacggggacccgcacaagcagtggagtatgtggtttaattcgaagcaacgcgaagaaccttaccaggtcttgacatccctctgaatctgctagagatagcagcggccttcgggacagaggagacaggtggtgcatggttgtcgtcagctcgtgtcgtgagatgttgggttaagtcccgcaacgagcgcaacccttgaattcagttgccagcacatcatggtgggcactctgaattgactgccggtgacaaaccggaggaaggcggggatgacgtcaaatcatcatgccccttatgacctgggctacacacgtactacaatggccggtacaacgggccgcgaaaccgcgaggtggagccaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 708 - DNA, 1557 bp, Paenibacillus humicus
  ref <308>: DATABASE ACCESSION NUMBER: NCBI ACCESSION: NZ_BIMD01000104.1
  ref <309>: DATABASE ENTRY DATE: 2019-04-01
  ref <313>: RELEVANT RESIDUES IN SEQ ID NO: (1)..(1557)
cctttatggagagtttgatcctggctcaggacgaacgctggcggcgtgcctaatacatgcaagtcgagcggatcttgtccttcgggacaaggttagcggcggacgggtgagtaacacgtaggcaacctgccctcaagactgggataacctccggaaacggatgctaataccggatatgcggtctctcctcctggagggatcgggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaggaaggccttcgggtcgtaaagctctgttgccagggaagaacgggtggaagagtaactgcttccgccatgacggtacctgagaagaaagccccggctaactacgtgccagcagccgcggtaatacgtagggggcaagcgttgtccggaattattgggcgtaaagcgcgcgcaggcggctttgtaagtccggtgtttaatcttggggctcaaccccaagtcgcacgggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacaataagcattccgcctggggagtacgctcgcaagagtgaaactcaaaggaattgacggggacccgcacaagcagtggagtatgtggtttaattcgaagcaacgcgaagaaccttaccaggtcttgacatccccctgaatcacctagagataggtgcggccttcgggacaggggagacaggtggtgcatggttgtcgtcagctcgtgtcgtgagatgttgggttaagtcccgcaacgagcgcaacccttgaattcagttgccagcacctcgggtgggcactctgaattgactgccggtgacaaaccggaggaaggcggggatgacgtcaaatcatcatgccccttatgacctgggctacacacgtactacaatggccggtacaacgggccgcgaagccgcgaggcggagccaatccttaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 709 - DNA, 1568 bp, Paenibacillus ihbetae
  ref <308>: DATABASE ACCESSION NUMBER: NCBI ACCESSION: NZ_CP016809.1
  ref <309>: DATABASE ENTRY DATE: 2019-04-01
  ref <313>: RELEVANT RESIDUES IN SEQ ID NO: (1)..(1568)
aatccttattggagagtttgatcctggctcaggacgaacgctggcggcgtgcctaatacatgcaagtcgagcggagcaacggtttccttcgggaaaccgttagcttagcggcggacgggtgagtaacacgtaggcaacctgccctcaagactgggataactaccggaaacggtagctaataccggataattaaacctgctgcatggcagggttatgaaaggcggagcaatctgtcacttgaggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtctcatagagtaactgctatgagagtgacggtacctgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggacgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcgaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagataggggcggccttcgggacagaggagacaggtggtgcatggttgtcgtcagctcgtgtcgtgagatgttgggttaagtcccgcaacgagcgcaacccttgatcttagttgccagcactttgggtgggcactctaaggtgactgccggtgacaaaccggaggaaggtggggatgacgtcaaatcatcatgccccttatgacttgggctacacacgtactacaatggctggtacaacgggaagcgaaggagcgatctggagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccttacgggagccagccgccgaaggtggggtagatgattggggtgaagtcgtaacaaggtagccgtatcggaaggtgcggctggatcacctcctttctatggag

SEQ ID NO: 710 - DNA, 1554 bp, Paenibacillus ihuae
  ref <308>: DATABASE ACCESSION NUMBER: NCBI ACCESSION: NZ_LN831210.1
  ref <309>: DATABASE ENTRY DATE: 2019-04-01
  ref <313>: RELEVANT RESIDUES IN SEQ ID NO: (1)..(1554)
ttggagagtttgatcctggctcaggacgaacgctggcggcgtgcctaatacatgcaagtcgagcggagcttatccttcgggataagcttagcggcggacgggtgagtaacacgtaggcaacctacccctcagactgggataactaccggaaacggtagctaataccggataattccttttctctcatgagaagaggatgaaaggcggagcaatctgctactaagggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctggggtcgcactggaaactggatggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatcccgatgtaagcattagagatagtgcccctcttcggagcatcggagacaggtggtgcatggttgtcgtcagctcgtgtcgtgagatgttgggttaagtcccgcaacgagcgcaacccttgactttagttgccagcaggtgaagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 711 - DNA, 1333 bp, Paenibacillus illinoisensis
  ref <308>: DATABASE ACCESSION NUMBER: NCBI ACCESSION: NZ_BIME01000028.1
  ref <309>: DATABASE ENTRY DATE: 2019-04-01
  ref <313>: RELEVANT RESIDUES IN SEQ ID NO: (1)..(1333)
acgaacgctggcggcatgcctaatacatgcaagtcgagcggacttgatgagaagcttgcttctctgatggttagcggcggacgggtgagtaacacgtaggcaacctgccctcaagcttgggacaactaccggaaacggtagctaataccgaatacttgctttcttcgcctgaaggaagctggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccttgagagtaactgctcaaggagtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaat

SEQ ID NO: 712 - DNA, 1554 bp, Paenibacillus jamilae
  ref <308>: DATABASE ACCESSION NUMBER: NCBI ACCESSION: NZ_QVPU01000089.1
  ref <309>: DATABASE ENTRY DATE: 2019-04-01
  ref <313>: RELEVANT RESIDUES IN SEQ ID NO: (1)..(1554)
ttaatggagagtttgatcctggctcaggacgaacgctggcggcgtgcctaatacatgcaagtcgagcggggttagttagaagcttgcttctaactaacctagcggcggacgggtgagtaacacgtaggcaacctgcccacaagacagggataactaccggaaacggtagctaatacccgatacatccttttcctgcatgggagaaggaggaaaggcggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaagccgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctccttt

SEQ ID NO: 713 - DNA, 1454 bp, Paenibacillus kobensis
  ref <308>: DATABASE ACCESSION NUMBER: NCBI ACCESSION: NZ_BILZ01000135.1
  ref <309>: DATABASE ENTRY DATE: 2019-04-01
  ref <313>: RELEVANT RESIDUES IN SEQ ID NO: (1)..(1454)
gcggcgtgcctaatacatgcaagtcgagcggatctgaaggagtgcttgcactcctgatggttagcggcggacgggtgagtaacacgtaggtaacctgcctacaagacgggataacattcggaaacgaatgctaataccggatacgcgatttcctcgcatggggagatcgggaaagacggagcaatctgtcacttgtagatggacctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggctttgtaagtctgtcgtttaagttcggggctcaaccccgtatcgcgatggaaactgcaaggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccaggtcttgacatccctctgaccgtcctagagatagggcttcccttcggggcagaggagacaggtggtgcatggttgtcgtcagctcgtgtcgtgagatgttgggttaagtcccgcaacgagcgcaacccttgattttagttgccagcacttaaaggtgggcactctagaatgactgccggtgacaaaccggaggaaggcggggatgacgtcaaatcatcatgccccttatgacctgggctacacacgtactacaatggccggtacaacgggctgcgaaggagcgatccggagcgaatccttaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatg

SEQ ID NO: 714 - DNA, 1308 bp, Paenibacillus koleovorans
  ref <308>: DATABASE ACCESSION NUMBER: NCBI ACCESSION: NZ_BIMA01000252.1
  ref <309>: DATABASE ENTRY DATE: 2019-04-01
  ref <313>: RELEVANT RESIDUES IN SEQ ID NO: (1)..(1308)
cggaaacgatagctaataccggatacgcggttggatcgcatgatccgatcgggaaagagggtttcggctctcacttacggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttctcggatcgtaaagctctgttgccagggaagaacggcagggggagtaactgccctcggcatgacggtacctgagaagaaagccccggctaactacgtgccagcagccgcggtaatacgtagggggcaagcgttgtccggaattattgggcgtaaagcgcgcgcaggcggtggattaagtttggtgtttaagcccggggctcaaccccggatcgcactgaaaactggtcgacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttaggggtttcgatacccttggtgccgaagtaaacacagtaagcactccgcctggggagtacggtcgcaagactgaaactcaaaggaattgacggggacccgcacaagcagtggagtatgtggtttaattcgaagcaacgcgaagaaccttaccaggtcttgacatcctcctgaatacgttagagatagcgtaggcccttcggggacaggggagacaggtggtgcatggttgtcgtcagctcgtgtcgtgagatgttgggttaagtcccgcaacgagcgcaacccttgatcttagttgccagcacttgggtgggcactctaggatgactgccggtgacaaaccggaggaaggcggggatgacgtcaaatcatcatgccccttatgacctgggctacacacgtactacaatggccggtacaacgggccgcgaagccgcgaggcggagccaatcccaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaacccgcaa

SEQ ID NO: 715 - DNA, 1566 bp, Paenibacillus kribbensis
  ref <308>: DATABASE ACCESSION NUMBER: NCBI ACCESSION: NZ_CP020028.1
  ref <309>: DATABASE ENTRY DATE: 2019-04-01
  ref <313>: RELEVANT RESIDUES IN SEQ ID NO: (1)..(1566)
tttattggagagtttgatcctggctcaggacgaacgctggcggcgtgcctaatacatgcaagtcgagcggggtcatgtagaagcttgcttctacatgacctagcggcggacgggtgagtaacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggagagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagatctttccttcgggacagaggagacaggtggtgcatggttgtcgtcagctcgtgtcgtgagatgttgggttaagtcccgcaacgagcgcaacccttatgcttagttgccagcaggtaaagctgggcactctaagcagactgccggtgacaaaccggaggaaggtggggatgacgtcaaatcatcatgccccttatgacctgggctacacacgtactacaatggccggtacaacgggaagcgaaatcgcgaggtggagcgaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 716 - DNA, 1564 bp, Paenibacillus lactis
  ref <308>: DATABASE ACCESSION NUMBER: NCBI ACCESSION: NZ_AGIP01000016.1
  ref <309>: DATABASE ENTRY DATE: 2019-04-01
  ref <313>: RELEVANT RESIDUES IN SEQ ID NO: (1)..(1564)
tttattggagagtttgatcctggctcaggacgaacgctggcggcgtgcctaatacatgcaagtcgagcggacttgatgaggagcttgcttctctgagagttagcggcggacgggtgagtaacacgtaggcaacctgccctcaagactgggataactaccggaaacggtagctaataccggataattaaattcgctgcatggcgggtttatgaaaggcggagcaatctgtcacttgaggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtctcatagagtaactgctatgagagtgacggtacctgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggacgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcgaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagataggggcggccttcgggacagaggagacaggtggtgcatggttgtcgtcagctcgtgtcgtgagatgttgggttaagtcccgcaacgagcgcaacccttgatcttagttgccagcactttgggtgggcactctaaggtgactgccggtgacaaaccggaggaaggtggggatgacgtcaaatcatcatgccccttatgacttgggctacacacgtactacaatggctggtacaacgggaagcgaagccgcgaggtggagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccttacgggagccagccgccgaaggtggggtagatgattggggtgaagtcgtaacaaggtagccgtatcggaaggtgcggctggatcacctcctttctatggaga

SEQ ID NO: 717 - DNA, 1564 bp, Paenibacillus larvae
  ref <308>: DATABASE ACCESSION NUMBER: NCBI ACCESSION: NZ_CP019659.1
  ref <309>: DATABASE ENTRY DATE: 2019-04-01
  ref <313>: RELEVANT RESIDUES IN SEQ ID NO: (1)..(1564)
tttattggagagtttgatcctggctcaggacgaacgctggcggcgtgcctaatacatgcaagtcgagcggaccttgtgtttccttcgggagacgccaggttagcggcggacgggtgagtaacacgtaggcaacctgcctgtaagaccgggataacttgcggaaacgtgagctaatactggatagctggtttcttcgcatgaagaagtcatgaaagacggggcaacctgtcacttacagatgggcctgcggcgcattagctagttggtagggtaacggcttaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccaaggaagaacggccaggggagtaactgcccctggagtgacggtacttgagaagaaagccccggctaactacgtgccagcagccgcggtaatacgtagggggcaagcgttgtccggaattattgggcgtaaagcgcgcgcaggcggtcttttaagtctggtgtttaagcccggggctcaaccccggttcgcactggaaactgggagacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgaatgctaggtgttaggggtttcgatacccttggtgccgaagttaacacagtaagcattccgcctggggagtacggtcgcaagactgaaactcaaaggaattgacggggacccgcacaagcagtggagtatgtggtttaattcgaagcaacgcgaagaaccttaccaggccttgacatccctctgaccggtttagagatagaccttttccttcggggacagaggagacaggtggtgcatggttgtcgtcagctcgtgtcgtgagatgttgggttaagtcccgcaacgagcgcaacccttgatcttagttgccagcacgcagaggtgggcactctaagatgactgccggtgacaaaccggaggaaggtggggatgacgtcaaatcatcatgccccttatggcctgggctacacacgtactacaatggtcggtacaacgggaagcgaaggagcgatccggagccaatcctcaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggag

SEQ ID NO: 718 - DNA, 1565 bp, Paenibacillus lautus
  ref <308>: DATABASE ACCESSION NUMBER: NCBI ACCESSION: NZ_BIMF01000051.1
  ref <309>: DATABASE ENTRY DATE: 2019-04-01
  ref <313>: RELEVANT RESIDUES IN SEQ ID NO: (1)..(1565)
tttattggagagtttgatcctggctcaggacgaacgctggcggcgtgcctaatacatgcaagtcgagcggacttgatggagtgcttgcactcctgaaggttagcggcggacgggtgagtaacacgtaggcaacctgccctcaagactgggataactaccggaaacggtagctaataccggataatttatttcacagcattgtggaataatgaaagacggagcaatctgtcacttggggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactgggggacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcacttcgggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 719 - DNA, 1553 bp, Paenibacillus lentimorbus
  ref <308>: DATABASE ACCESSION NUMBER: NCBI ACCESSION: NZ_ANAT01000002.1
  ref <309>: DATABASE ENTRY DATE: 2019-04-01
  ref <313>: RELEVANT RESIDUES IN SEQ ID NO: (1)..(1553)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttct

SEQ ID NO: 720 - DNA, 1565 bp, Paenibacillus lentus
  ref <308>: DATABASE ACCESSION NUMBER: NCBI ACCESSION: NZ_CP034248.1
  ref <309>: DATABASE ENTRY DATE: 2019-04-01
  ref <313>: RELEVANT RESIDUES IN SEQ ID NO: (1)..(1565)
tttattggagagtttgatcctggctcaggacgaacgctggcggcgtgcctaatacatgcaagtcgagcgggattattttggaagcttgcttccaaaataatctagcggcggacgggtgagtaatacgtaggcaacctgcccctcagcctgggataactagcggaaacgttagctaataccggataatttgtttcttcgcatgaaggagcaatgaaagacggagcaatctgtcactaagggatgggcctacggcgcattagctagttggtgaggtaatggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgtcttggagagtaactgctctaagagtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaactccgggtcgcactggaaactgggtggcttgagtgcagaagaggagagtggaattccacgtgtagcggtgaaatgcgtagatatgtggaggaacaccagtggcgaaggcgactctctgggctgtaactgacgctgaggcgcgaaagcgtgggtagcaaacaggattagataccctggtagtccacgccgtaaacgatgaatgctaggtgttaggggtttcgatacccttggtgccgaagtaaacacattaagcattccgcctggggagtacggtcgcaagactgaaactcaaaggaattgacggggacccgcacaagcagtggagtatgtggtttaattcgaagcaacgcgaagaaccttaccaggtcttgacatgcctctgaccgctctagagatagagcttctcttcggagcaggggacacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccagtacaacgggaagcgaaaccgcgaggtggagcgaatcctatcaaagttggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggaga

SEQ ID NO: 721 - DNA, 1575 bp, Paenibacillus macerans
  ref <308>: DATABASE ACCESSION NUMBER: NCBI ACCESSION: NZ_UGSI01000002.1
  ref <309>: DATABASE ENTRY DATE: 2019-04-01
  ref <313>: RELEVANT RESIDUES IN SEQ ID NO: (1)..(1575)
tttattggagagtttgatcctggctcaggacgaacgctggcggcgtgcctaatacatgcaagtcgagcggagttaatcgggagcttgctcctgattaacttagcggcggacgggtgagtaacacgtaggcaacctgcccgtaagaccgggataactaccggaaacggtagctaataccggataatcaagcttctcgcatgagaggcttgggaaaggcggttctgaatttattcagggctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcttctggagtaactgccaggagagtgacggtacctgagaagaaagccccggctaactacgtgccagcagccgcggtaatacgtagggggcaagcgttgtccggaattattgggcgtaaagcgcgcgcaggcggctgtttaagtctggtgtataatcctggggctcaactccgggtcgcactggaaactggacggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagtaaacacattaagcactccgcctggggagtacggccgcaaggctgaaactcaaaggaattgacggggacccgcacaagcagtggagtatgtggtttaattcgaagcaacgcgaagaaccttaccaggtcttgacatccctctgaccgctgtagagatatggctttccttcgggacagaggagacaggtggtgcatggttgtcgtcagctcgtgtcgtgagatgttgggttaagtcccgcaacgagcgcaacccttgactttagttgccagcaagtaaagttgggcactctagagtgactgccggtgacaaaccggaggaaggtggggatgacgtcaaatcatcatgccccttatgacctgggctacacacgtactacaatggccggtacaacgggaagcgaagtcgtgagatggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggag

SEQ ID NO: 722 - DNA, 1511 bp, Paenibacillus montanisoli
  ref <308>: DATABASE ACCESSION NUMBER: NCBI ACCESSION: NZ_QLUW01000011.1
  ref <309>: DATABASE ENTRY DATE: 2019-04-01
  ref <313>: RELEVANT RESIDUES IN SEQ ID NO: (1)..(1511)
cccagagtttgatcctggctcaggacgaacgctggcggcgtgcctaatacatgcaagtcgagcggatcttcccttcggggaaggttagcggcggacgggtgagtaacacgtaggcaacctgcctgtaagaccgggataacattcggaaacgaatgctaataccggatacgcagcctgatcgcatgatcgggctgggaaagacggtgcaagctgtcacttacagatgggcctgcggtgcattagctagttggtgaggtaacggctcaccaaggcgacgatgcatagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacagccaggggagtaactgcccttggaatgacggtacctgagaagaaagccccggctaactacgtgccagcagccgcggtaatacgtagggggcaagcgttgtccggaattattgggcgtaaagcgcgcgcaggcggctttgtaagtctagtgtttaagctcggagctcaactccgattcgcaccggaaactgcaaggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccagctcttgacatccctctgaatcctctagagatagaggcggcccttcggggacagaggagacaggtggtgcatggttgtcgtcagctcgtgtcgtgagatgttgggttaagtcccgcaacgagcgcaacccctaattttagttgccagcacgtaatggtgggcactctaaagtgactgccggtgacaaaccggaggaaggtggggatgacgtcaaatcatcatgccccttatgagctgggctacacacgtactacaatggccgttacaacgggaagcgaagccgcgaggtggagccaatcctaaaaaggcggtctcagatcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtgggggagatgattggggtgaagtcgtaacaaggtaacc

SEQ ID NO: 723 - DNA, 872 bp, Paenibacillus nanensis
  ref <308>: DATABASE ACCESSION NUMBER: NCBI ACCESSION: NZ_QXQA01000042.1
  ref <309>: DATABASE ENTRY DATE: 2019-04-01
  ref <313>: RELEVANT RESIDUES IN SEQ ID NO: (1)..(872)
gggataacattcggaaacgaatgctaataccggatacgcgagttggtcgcatggccgactcgggaaagacggagcaatctgtcgcttacagatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggttcattaagtctggtgtttaaggctggggctcaaccccggttcgcactggaaactggtgaacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccg

SEQ ID NO: 724 - DNA, 1565 bp, Paenibacillus odorifer
  ref <308>: DATABASE ACCESSION NUMBER: NCBI ACCESSION: NZ_CP021965.1
  ref <309>: DATABASE ENTRY DATE: 2019-04-01
  ref <313>: RELEVANT RESIDUES IN SEQ ID NO: (1)..(1565)
attggagagtttgatcctggctcaggacgaacgctggcggcgtgcctaatacatgcaagtcgagcggagttactttgaaagcttgctttcaaagtaacttagcggcggacgggtgagtaacacgtaggcaacctgcccttcagactgggataactaccggaaacggtagctaataccggataatttcttttttctcctgagagaagaatgaaagacggagcaatctgtcactgagggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttaactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccatcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 725 - DNA, 300 bp, Paenibacillus pabuli
  ref <308>: DATABASE ACCESSION NUMBER: NCBI ACCESSION: NZ_QLLI01000006.1
  ref <309>: DATABASE ENTRY DATE: 2019-04-01
  ref <313>: RELEVANT RESIDUES IN SEQ ID NO: (1)..(300)
tttattggagagtttgatcctggctcaggacgaacgctggcggcatgcctaatacatgcaagtcgagcggacttgatgagaagcttgcttctctgatggttagcggcggacgggtgagtaacacgtaggcaacctgccctcaagcttgggacaactaccggaaacggtagctaataccgaatagttgttttcttcacctgaaggaaactggaaagacggagcaatctgtcacttggggatgggcctgcggcgcattagctagttggtggggtaacggctcaccaaggcgacgatgcgtag

SEQ ID NO: 726 - DNA, 1562 bp, Paenibacillus paeoniae
  ref <308>: DATABASE ACCESSION NUMBER: NCBI ACCESSION: NZ_QUBQ01000013.1
  ref <309>: DATABASE ENTRY DATE: 2019-04-01
  ref <313>: RELEVANT RESIDUES IN SEQ ID NO: (1)..(1562)
tttatggagagtttgatcctggctcaggacgaacgctggcggcgtgcctaatacatgcaagtcgagcggacttgatgaagtgcttgcacttctgatagttagcggcggacgggtgagtaacacgtaggtaacctgcctgtaagactgggataacattcggaaacgaatgctaataccggatacgcgaattggtcgcatggccgattcgggaaagacggagcaatctgtcacttacagatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcaattaagtctggtgtttaaggctggggctcaaccccagttcgcactggaaactggttgacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgaccggtacagagatgtacctttccttcgggacaaaggagacaggtggtgcatggttgtcgtcagctcgtgtcgtgagatgttgggttaagtcccgcaacgagcgcaacccctatttttagttgccagcacttcgggtgggcactctagaaagactgccggtgacaaaccggaggaaggtggggatgacgtcaaatcatcatgccccttatgacctgggctacacacgtactacaatggccagtacaacgggaagcgaaaccgcgaggtggagccaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaagga

SEQ ID NO: 727 - DNA, 1147 bp, Paenibacillus pasadenensis
  ref <308>: DATABASE ACCESSION NUMBER: NCBI ACCESSION: NZ_BIMM01000176.1
  ref <309>: DATABASE ENTRY DATE: 2019-04-01
  ref <313>: RELEVANT RESIDUES IN SEQ ID NO: (1)..(1147)
cctggggagatcgggaaagacggagcaatctgttactcggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgccagggaagaacgcttgggagagtaactgctccaaggtgacggtacctgagaagaaagccccggctaactacgtgccagcagccgcggtaatacgtagggggcaagcgttgtccggaattattgggcgtaaagcgcgcgcaggcggctttgtaagtccggtgtttaatcttggggctcaaccccaagtcgcacgggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacaataagcattccgcctggggagtacgctcgcaagagtgaaactcaaaggaattgacggggacccgcacaagcagtggagtatgtggtttaattcgaagcaacgcgaagaaccttaccaggtcttgacatccctctgaatccgctagagatagcggcggccttcgggacagaggagacaggtggtgcatggttgtcgtcagctcgtgtcgtgagatgttgggttaagtcccgcaacgagcgcaacccttgaattcagttgccagcacgtaagggtgggcactctgaattgactgccggtgacaaaccggaggaaggcggggatgacgtcaaatcatcatgccccttatgacctgggctacacacgtactacaatggccggtacaacgggccgcgaagccgcgaggcggagccaatccttaaaagccggtctcagttcggattgcaggctgcaactcgcctgcatga

SEQ ID NO: 728 - DNA, 1564 bp, Paenibacillus phocaensis
  ref <308>: DATABASE ACCESSION NUMBER: NCBI ACCESSION: NZ_FCOQ01000013.1
  ref <309>: DATABASE ENTRY DATE: 2019-04-01
  ref <313>: RELEVANT RESIDUES IN SEQ ID NO: (1)..(1564)
tttattggagagtttgatcctggctcaggacgaacgctggcggcgtgcctaatacatgcaagtcgagcggagttaattaggagcttgctcttgattaacttagcggcggacgggtgagtaacacgtaggcaacctgcccgtaagactgggataactaccggaaacggtagctaataccggatacgcaagtttctcgcatgggagacttgggaaaggcggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaagaaggttttcggatcgtaaagctctgttgccagggaagaacgtcctctagagtaactgctaggggagtgacggtacctgagaagaaagccccggctaactacgtgccagcagccgcggtaatacgtagggggcaagcgttgtccggaattattgggcgtaaagcgcgcgcaggcggctgtttaagtctggtgtataaacctggggctcaactccgggtcgcactggaaactgggcagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggccgcaaggctgaaactcaaaggaattgacggggacccgcacaagcagtggagtatgtggtttaattcgaagcaacgcgaagaaccttaccaggtcttgacatccctctgacccctctagagatagaggtttccttcgggacagaggagacaggtggtgcatggttgtcgtcagctcgtgtcgtgagatgttgggttaagtcccgcaacgagcgcaacccttgactttagttgccagcaggtagagctgggcactctagagtgactgccggtgacaaaccggaggaaggtggggatgacgtcaaatcatcatgccccttatgacctgggctacacacgtactacaatggccggtacaacgggaagcgaaggagcgatctggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 729 - DNA, 1565 bp, Paenibacillus physcomitrellae
  ref <308>: DATABASE ACCESSION NUMBER: NCBI ACCESSION: NZ_CP022584.1
  ref <309>: DATABASE ENTRY DATE: 2019-04-01
  ref <313>: RELEVANT RESIDUES IN SEQ ID NO: (1)..(1565)
cttttatggagagtttgatcctggctcaggacgaacgctggcggcgtgcctaatacatgcaagtcgagcggagccttaggagagcttgctctcctgagacttagcggcggacgggtgagtaacacgtaggcaacctgcctgcaagactgggataactaccggaaacggtagctaataccggatacgcagtttcctcgcatgagggagctgggaaagacggagcaatctgtcacttgcggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcgggtagagtaactgctacccgagtgacggtacctgagaagaaagccccggctaactacgtgccagcagccgcggtaatacgtagggggcaagcgttgtccggaattattgggcgtaaagcgcgcgcaggcggccatttaagtctggtgtttaatcccggggctcaactccgggtcgcactggaaactgggtggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggatcagagatggtcctttccttcgggacaggggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaaggagcgatctggagcgaatccttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtggggtagacgattggggtgaagtcgtaacaaggtagccgtatcggaaggtgcggctggatcacctcctttctatggag

SEQ ID NO: 730 - DNA, 1357 bp, Paenibacillus pinisoli
  ref <308>: DATABASE ACCESSION NUMBER: NCBI ACCESSION: NZ_QXQB01000013.1
  ref <309>: DATABASE ENTRY DATE: 2019-04-01
  ref <313>: RELEVANT RESIDUES IN SEQ ID NO: (1)..(1357)
tcgggaaagacggagcaatctgtcacttacagatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcaattaagtctggtgtttaaggctggggctcaaccccagttcgcactggaaactggttgacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtgcctttccttcgggacattcaagacaggtggtgcatggttgtcgtcagctcgtgtcgtgagatgttgggttaagtcccgcaacgagcgcaacccctatttttagttgccagcacttcgggtgggcactctaaagagactgccggtgacaaaccggaggaaggtggggatgacgtcaaatcatcatgccccttatgacctgggctacacacgtactacaatggccagtacaacgggaagcgaaaccgcgaggtggagccaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaagga

SEQ ID NO: 731 - DNA, 1563 bp, Paenibacillus polymyxa
  ref <308>: DATABASE ACCESSION NUMBER: NCBI ACCESSION: NZ_UATJ01000055.1
  ref <309>: DATABASE ENTRY DATE: 2019-04-01
  ref <313>: RELEVANT RESIDUES IN SEQ ID NO: (1)..(1563)
ttaatggagagtttgatcctggctcaggacgaacgctggcggcgtgcctaatacatgcaagtcgagcggggttagttagaagcttgcttctaattaacctagcggcggacgggtgagtaacacgtaggcaacctgcccacaagacagggataactaccggaaacggtagctaatacccgatacatccttttcctgcatgggagaaggaggaaaggcggagcaatctgtcgcttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgcttgagagagtaactgctcttgaggtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggagagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagataggcctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaggagcgatttggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 732 - DNA, 228 bp, Paenibacillus polysaccharolyticus
  ref <308>: DATABASE ACCESSION NUMBER: NCBI ACCESSION: NZ_FMVM01000026.1
  ref <309>: DATABASE ENTRY DATE: 2019-04-01
  ref <313>: RELEVANT RESIDUES IN SEQ ID NO: (1)..(228)
ctttattggagagtttgatcctggctcaggacgaacgctggcggcatgcctaatacatgcaagtcgagcggacttgaagagaagcttgcttctctgatggttagcggcggacgggtgagtaacacgtaggcaacctgccctcaagcttgggacaactaccggaaacggtagctaataccgaatacttgttttcttcgcctgaagagaattggaaagacggagcaatct

SEQ ID NO: 733 - DNA, 1309 bp, Paenibacillus popilliae
  ref <308>: DATABASE ACCESSION NUMBER: NCBI ACCESSION: NZ_BALG01000325.1
  ref <309>: DATABASE ENTRY DATE: 2019-04-01
  ref <313>: RELEVANT RESIDUES IN SEQ ID NO: (1)..(1309)
cgcattagctagttggtgaggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgctatggagagtaactgttccataggtgacggtacctgagaagaaagccccggctaactacgtgccagcagccgcggtaatacgtagggggcaagcgttgtccggaattattgggcgtaaagcgcgcgcaggcggtcatgtaagtctggtgtttaaacccggggctcaactccgggtcgcatcggaaactgtgtgacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgcgctagagatagggcttcccttcggggcagaggagacaggtggtgcatggttgtcgtcagctcgtgtcgtgagatgttgggttaagtcccgcaacgagcgcaacccttaactttagttgccagcattgagttgggcactctagagtgactgccggtgacaaaccggaggaaggtggggatgacgtcaaatcatcatgccccttatgacctgggctacacacgtactacaatggctggtacaacgggaagcgaagccgcgaggtggagcgaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctggatcacctcctttctaagga

SEQ ID NO: 734 - DNA, 1464 bp, Paenibacillus prosopidis
  ref <308>: DATABASE ACCESSION NUMBER: NCBI ACCESSION: NZ_QPJD01000076.1
  ref <309>: DATABASE ENTRY DATE: 2019-04-01
  ref <313>: RELEVANT RESIDUES IN SEQ ID NO: (1)..(1464)
ttagcggcggacgggtgagtaacacgtaggtaacctgcccgtaagactgggataacattcggaaacgaatgctaataccggatacacagcttggtcgcatgaccttgctgggaaagatggagcaatctatcacttacggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggccttgtaagtctgttgtttaaactcggggctcaaccccgagtcgcaatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgctctagagatagggctttccttcgggacagaggagacaggtggtgcatggttgtcgtcagctcgtgtcgtgagatgttgggttaagtcccgcaacgagcgcaacccttgatcttagttgccagcactttgggtgggcactctaagatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacccgcaagggagctagccgtcgaaggtggggtagatgattggggtgaagtcgtaacaaggtagccgtatcggaaggtgcggctggatcacctcctttctaagga

SEQ ID NO: 735 - DNA, 1547 bp, Paenibacillus rigui
  ref <308>: DATABASE ACCESSION NUMBER: NCBI ACCESSION: NZ_NMQW01000006.1
  ref <309>: DATABASE ENTRY DATE: 2019-04-01
  ref <313>: RELEVANT RESIDUES IN SEQ ID NO: (1)..(1547)
tggagagtttgatcctggctcaggacgaacgctggcggcgtgcctaatacatgcaagtcgagcggatttcaccttcgggtgaagttagcggcggacgggtgagtaacacgtaggcaacctgcctgtaagactgggataactatcggaaacgatagctaagaccggatagctggttctctcgcatgagggaatcatgaaacacggagcaatctgtggcttacagatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgctcaggagagtaactgctcctgaggtgacggtacctgagaagaaagccccggctaactacgtgccagcagccgcggtaatacgtagggggcaagcgttgtccggaattattgggcgtaaagcgcgcgcaggcggttatttaagtttggtgtttaagcccggggctcaaccccggatcgcactgaaaactggatgacttgagtgcgggagaggaaagtggaattccacgtgtagcggtgaaatgcgtagagatgtggaggaacaccagtggcgaaggcgactttctggaccgtaactgacgctgaggcgcgaaagcgtggggagcaaacaggattagataccctggtagtccacgccgtaaacgatgagtgctaggtgttaggggtttcgatacccttggtgccgaagtaaacacagtaagcactccgcctggggagtacgctcgcaagagtgaaactcaaaggaattgacggggacccgcacaagcagtggagtatgtggtttaattcgaagcaacgcgaagaaccttaccaggtcttgacatccctctgcaagccatagagatatggccctccttcgggacagaggagacaggtggtgcatggttgtcgtcagctcgtgtcgtgagatgttgggttaagtcccgcaacgagcgcaacccttgactttagttgccagcattaagttgggcactctagagtgactgccggtgacaaaccggaggaaggtggggatgacgtcaaatcatcatgccccttatgacctgggctacacacgtactacaatggccggtacaacgggaagcgaagccgcgaggtggagcgaatctttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggag

SEQ ID NO: 736 - DNA, 1363 bp, Paenibacillus riograndensis
  ref <308>: DATABASE ACCESSION NUMBER: NCBI ACCESSION: NZ_LIRB01000055.1
  ref <309>: DATABASE ENTRY DATE: 2019-04-01
  ref <313>: RELEVANT RESIDUES IN SEQ ID NO: (1)..(1363)
ggatgaaaggcggagcaatctgctgctagaggatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctgccggagtgacggtacctgagaagaaagccccggctaactacgtgccagcagccgcggtaatacgtagggggcaagcgttgtccggaattattgggcgtaaagcgcgcgcaggcggctgcttaagtctggtgtttaaaccttgggctcaacctggggtcgcactggaaactgggcagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtaaagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtggggtagatgattggggtgaagtcgtaacaaggtagccgtatcggaaggtgcggctggatcacctcctttctatggaga

SEQ ID NO: 737 - DNA, 1369 bp, Paenibacillus rubinfantis
  ref <308>: DATABASE ACCESSION NUMBER: NCBI ACCESSION: NZ_LN909060.1
  ref <309>: DATABASE ENTRY DATE: 2019-04-01
  ref <313>: RELEVANT RESIDUES IN SEQ ID NO: (1)..(1369)
atcgcatggtggacttgggaaagacggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccgttagagtaactgctaacggagtgacggtacctgagaagaaagccccggctaactacgtgccagcagccgcggtaatacgtagggggcaagcgttgtccggaattattgggcgtaaagcgcgcgcaggcggctgtttaagtctggtgtttaatcctggggctcaactccgggtcgcactggaaactgggcagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggccgcaaggctgaaactcaaaggaattgacggggacccgcacaagcagtggagtatgtggtttaattcgaagcaacgcgaagaaccttaccaggtcttgacatccctctgaccggtacagagatgtgcctttccttcgggacagaggagacaggtggtgcatggttgtcgtcagctcgtgtcgtgagatgttgggttaagtcccgcaacgagcgcaacccttgactttagttgccagcaattcggttgggcactctagagtgactgccggtgacaaaccggaggaaggtggggatgacgtcaaatcatcatgccccttatgacctgggctacacacgtactacaatggctggtacaacgggaagcgaaagagcgatctggagcgaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggag

SEQ ID NO: 738 - DNA, 265 bp, Paenibacillus sanguinis
  ref <308>: DATABASE ACCESSION NUMBER: NCBI ACCESSION: NZ_KB895407.1
  ref <309>: DATABASE ENTRY DATE: 2019-04-01
  ref <313>: RELEVANT RESIDUES IN SEQ ID NO: (1)..(265)
tttattggagagtttgatcctggctcaggacgaacgctggcggcgtgcctaatacatgcaagtcgagcggagtgattggggagcttgctcctggatcacttagcggcggacgggtgagtaacacgtaggcaacctgcctgtaagcctgggataactagcggaaacgttagctaataccggatagtcaagcctctcgcatgggagacttgggaaagacggagcaatctgtcacttatggatgggcctgcggcgcattagctagttg

SEQ ID NO: 739 - DNA, 1351 bp, Paenibacillus senegalensis
  ref <308>: DATABASE ACCESSION NUMBER: NCBI ACCESSION: NZ_CAES01000129.1
  ref <309>: DATABASE ENTRY DATE: 2019-04-01
  ref <313>: RELEVANT RESIDUES IN SEQ ID NO: (1)..(1351)
cgggtgagtaacacgtaggcaacctgcctgtaagatcgggataacttgcggaaacgtgagctaataccggatgtgcttgagtccacgcctgtgggtttaaggaaagacggagcaatctgtcacttacagatgggcctgcggcgcattagctagttggtgaggtaacggctcaccaaggcgacgatgcgtagccgacctgagagggtgaccggccacactgggactgagacacggcccagactcctacgggaggcagcagtagggaatcttcggcaatggacggaagtctgaccgagcaacgccgcgtgagtgaagaaggttttcggatcgtaaaactctgttgccagagaagaacgccaaggagagtaactgctctttgggtgacggtatctgagaagaaagccccggctaactacgtgccagcagccgcggtaatacgtagggggcaagcgttgtccggaattattgggcgtaaagcgcgcgcaggcggtgaattaagtctgatgtttaaacccggggctcaacctcgggtcgcattggaaactggttgactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgaatgctaggtgtcaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgaccggtgcagagatgtgcctttccttcgggacagaggagacaggtggtgcatggttgtcgtcagctcgtgtcgtgagatgttgggttaagtcccgcaacgagcgcaacccttgatgctagttgccagcattcagttgggcactctaggatgactgccggtgacaaaccggaggaaggtggggatgacgtcaaatcatcatgccccttatgacctgggctacacacgtactacaatggccggtacaacgggcagcgaaggagcgatctggagcgaatcccaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccc

SEQ ID NO: 740 - DNA, 1564 bp, Paenibacillus senegalimassiliensis
  ref <308>: DATABASE ACCESSION NUMBER: NCBI ACCESSION: NZ_LN909041.1
  ref <309>: DATABASE ENTRY DATE: 2019-04-01
  ref <313>: RELEVANT RESIDUES IN SEQ ID NO: (1)..(1564)
tttattggagagtttgatcctggctcaggacgaacgctggcggcgtgcctaatacatgcaagtcgagcggagttatttgggagcttgctcctaaataacttagcggcggacgggtgagtaacacgtaggtaacctgcctgtaagcctgggataactaacggaaacgttagctaataccggatacgcaagcctctcgcatgggagacttgggaaagacggagcaatctgtcacttatggatgggcctgcggcgcattagctagttggtagggtaacggcttaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgaagaaggttttcggatcgtaaagctctgttgccagggaagaatgtcttggagagtaactgctctgagagtgacggtacctgagaagaaagccccggctaactacgtgccagcagccgcggtaatacgtagggggcaagcgttgtccggaattattgggcgtaaagcgcgcgcaggcggttatttaagtctggtgtataaccttggggcttaacctcaagtggcactggaaactgggtagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggccgcaaggctgaaactcaaaggaattgacggggacccgcacaagcagtggagtatgtggtttaattcgaagcaacgcgaagaaccttaccaggtcttgacatcccaatgcaaacactagagatagtgtccttcttcggaacattggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagtcgcgagatggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 741 - DNA, 1565 bp, Paenibacillus silvae
  ref <308>: DATABASE ACCESSION NUMBER: NCBI ACCESSION: NZ_QKWW01000050.1
  ref <309>: DATABASE ENTRY DATE: 2019-04-01
  ref <313>: RELEVANT RESIDUES IN SEQ ID NO: (1)..(1565)
tttattggagagtttgatcctggctcaggacgaacgctggcggcatgcctaatacatgcaagtcgagcggacttgaggagaagcttgcttctctgatagttagcggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttatatttagttgccagcatttcggatgggcactctaaatagactgccggtgacaaaccggaggaaggtggggatgacgtcaaatcatcatgccccttatgacctgggctacacacgtactacaatggccggtacaacgggcagtgaagccgcgaggtggaaccaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 742 - DNA, 218 bp, Paenibacillus solani
  ref <308>: DATABASE ACCESSION NUMBER: NCBI ACCESSION: NZ_LIUT01000008.1
  ref <309>: DATABASE ENTRY DATE: 2019-04-01
  ref <313>: RELEVANT RESIDUES IN SEQ ID NO: (1)..(218)
tttattggagagtttgatcctggctcaggacgaacgctggcggcgtgcctaatacatgcaagtcgagcggacttgatggagagcttgctttcctgagagttagcggcggacgggtgagtaacacgtaggtaacctgccctcaagactgggataactaccggaaacggtagctaataccggataatttattttgctgcatggcgaaataatgaaagacg

SEQ ID NO: 743 - DNA, 1036 bp, Paenibacillus sonchi
  ref <308>: DATABASE ACCESSION NUMBER: NCBI ACCESSION: NZ_AJTY01000098.1
  ref <309>: DATABASE ENTRY DATE: 2019-04-01
  ref <313>: RELEVANT RESIDUES IN SEQ ID NO: (1)..(1036)
gagtaacacgtaggcaacctaccctctagactgggataactaccggaaacggtagctaataccggataattccttgaccctcctgggtttgggatgaaaggcggagcaatctgctgctagaggatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctgccggagtgacggtacctgagaagaaagccccggctaactacgtgccagcagccgcggtaatacgtagggggcaagcgttgtccggaattattgggcgtaaagcgcgcgcaggcggctgcttaagtctggtgtttaaaccttgggctcaacctggggtcgcactggaaactgggcagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcattaggtgcccttcggggaaagttgagacaggtggtgcatggttgtcgtcagctcgtgtcgtgagatgttgggttaagtcccgcaacgagcgcaacccttgactttagttgccagcaggta

SEQ ID NO: 744 - DNA, 439 bp, Paenibacillus sophorae
  ref <308>: DATABASE ACCESSION NUMBER: NCBI ACCESSION: NZ_FODH01000012.1
  ref <309>: DATABASE ENTRY DATE: 2019-04-01
  ref <313>: RELEVANT RESIDUES IN SEQ ID NO: (1)..(439)
ttattggagagtttgatcctggctcaggacgaacgctggcggcgtgcctaatacatgcaagtcgagcggagtatttttgagagcttgctctccagaatacttagcggcggacgggtgagtaacacgtaggcaacctgccccttgaactgggataactaccggaaacggtagctaataccggataattcctcttggcacctgctgggaggctgaaaggcggagcaatctgctgtcaagggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatc

SEQ ID NO: 745 - DNA, 1360 bp, Paenibacillus sp. 1011MAR3C5
  ref <308>: DATABASE ACCESSION NUMBER: NCBI ACCESSION: NZ_QZCF01000019.1
  ref <309>: DATABASE ENTRY DATE: 2019-04-01
  ref <313>: RELEVANT RESIDUES IN SEQ ID NO: (1)..(1360)
gattcgggaaagacggagcaatctgtcacttacagatggacctgcggcgcattagctagttggtgaggtaatggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcaattaagtctggtgtttaaggctggggctcaaccccagttcgcactggaaactggttgacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgaccggtacagagatgtacctttccttcgggacagaggagacaggtggtgcatggttgtcgtcagctcgtgtcgtgagatgttgggttaagtcccgcaacgagcgcaacccctatttttagttgccagcacttcgggtgggcactctagaaagactgccggtgacaaaccggaggaaggtggggatgacgtcaaatcatcatgccccttatgacctgggctacacacgtactacaatggccagtacaacgggaagcgaaaccgcgaggtggagccaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaagga

SEQ ID NO: 746 - DNA, 289 bp, Paenibacillus sp. 181mfcol5.1
  ref <308>: DATABASE ACCESSION NUMBER: NCBI ACCESSION: NZ_FNYX01000016.1
  ref <309>: DATABASE ENTRY DATE: 2019-04-01
  ref <313>: RELEVANT RESIDUES IN SEQ ID NO: (1)..(289)
tctttaatggagagtttgatcctggctcaggacgaacgctggcggcgtgcctaatacatgcaagtcgagcggggttaattagaagcttgcttctaactaacctagcggcggacgggtgagtaacacgtaggcaacctgcccacaagacagggataactaccggaaacggtagctaatacccgatacatccttttcctgcatgggagaaggaggaaaggcggagcaatctgtcacttgtggatgggcctgcggcgcattagctagttggtggggtaaaggcctaccaagg

SEQ ID NO: 747 - DNA, 1557 bp, Paenibacillus sp. 18JY67-1
  ref <308>: DATABASE ACCESSION NUMBER: NCBI ACCESSION: NZ_CP034437.1
  ref <309>: DATABASE ENTRY DATE: 2019-04-01
  ref <313>: RELEVANT RESIDUES IN SEQ ID NO: (1)..(1557)
cttttatggagagtttgatcctggctcaggacgaacgctggcggcgtgcctaatacatgcaagtcgagcggatcttgtccttcgggacaaggttagcggcggacgggtgagtaacacgtaggcaacctgcctgtaagaccgggataacattcggaaacggatgctaataccggatatacaacttggctgcatggctgagttgggaaagacggtgcaagctgtcacttacagatgggcctgcggtgcattagctagttggtggggtaacggctcaccaaggcgacgatgcatagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacagctaggcgagtaactgcgcttagaatgacggtacctgagaagaaagccccggctaactacgtgccagcagccgcggtaatacgtagggggcaagcgttgtccggaattattgggcgtaaagcgcgcgcaggcggctttgtaagtctagtgtttaatctcggagctcaactccgattcgcaccggaaactgcaaggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccagctcttgacatcccaatgaaagcattagagatagtgcccctcttcggagcattggagacaggtggtgcatggttgtcgtcagctcgtgtcgtgagatgttgggttaagtcccgcaacgagcgcaacccttgatcttagttgccagcaggtaaggctgggcactctaaggtgactgccggtgacaaaccggaggaaggtggggatgacgtcaaatcatcatgccccttatgagctgggctacacacgtactacaatggtcggtacaacgggaagcgaagccgcgaggtggagccaatcctataaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaagga

SEQ ID NO: 748 - DNA, 321 bp, Paenibacillus sp. 1 12
  ref <308>: DATABASE ACCESSION NUMBER: NCBI ACCESSION: NZ_FOTE01000012.1
  ref <309>: DATABASE ENTRY DATE: 2019-04-01
  ref <313>: RELEVANT RESIDUES IN SEQ ID NO: (1)..(321)
tggagagtttgatcctggctcaggacgaacgctggcggcgtgcctaatacatgcaagtcgagcggattgttccttcgggaacagttagcggcggacgggtgagtaacacgtaggcaacctgcctgcaggatcgggataactaccggaaacggtagctaagaccggataagtgattttgacgcatgttgagatcaagaaacacggagcaatctgtgacctgtagatgggcctgcggcgcattagctagttggtgaggtaacggctcaccaaggcgacgatgcgtagccgacctgagagggtgaacggccacactgggactga

SEQ ID NO: 749 - DNA, 338 bp, Paenibacillus sp. 276b
  ref <308>: DATABASE ACCESSION NUMBER: NCBI ACCESSION: NZ_FNRR01000012.1
  ref <309>: DATABASE ENTRY DATE: 2019-04-01
  ref <313>: RELEVANT RESIDUES IN SEQ ID NO: (1)..(338)
ctttattggagagtttgatcctggctcaggacgaacgctggcggcatgcctaatacatgcaagtcgagcggacttgaagagaagcttgcttctcggatagttagcggcggacgggtgagtaacacgtaggcaacctgccctcaagtttgggacaactaccggaaacggtagctaataccgaatagttgttttcttctcctgaagagaactggaaagacggagtaatctgtcacttggggatgggcctgcggcgcattagctagttggtggggtaacggctcaccaaggcgacgatgcgtagccgacctgagagggtgatcggccacactgggactgag

SEQ ID NO: 750 - DNA, 1535 bp, Paenibacillus sp. 3-5-3
  ref <308>: DATABASE ACCESSION NUMBER: NCBI ACCESSION: NZ_RZNX01000019.1
  ref <309>: DATABASE ENTRY DATE: 2019-04-01
  ref <313>: RELEVANT RESIDUES IN SEQ ID NO: (1)..(1535)
gacgaacgctggcggcgtgcctaatacatgcaagtcgagcggacttgatggagagcttgctctcctgatggttagcggcggacgggtgagtaacacgtaggtaacctgcctgtaagactgggataactaccggaaacggtagctaataccggataattcattttactgcatggtggagtgatgaaagacggagcaatctgtcacttacggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggttatttaagtctggtgtttaatcctggggctcaaccccgggtcgcaccggaaactgggtaacttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatcccaatgaaaacaccagagatggtgtccctcttcggagcattggtgacaggtggtgcatggttgtcgtcagctcgtgtcgtgagatgttgggttaagtcccgcaacgagcgcaacccttgattttagttgccagcactttgggtgggcactctagaatgactgccggtgacaaaccggaggaaggcggggatgacgtcaaatcatcatgccccttatgacttgggctacacacgtactacaatggccggtacaacgggaagcgaagccgcgaggtggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 751 - DNA, 275 bp, Paenibacillus sp. 453mf
  ref <308>: DATABASE ACCESSION NUMBER: NCBI ACCESSION: NZ_FPAC01000005.1
  ref <309>: DATABASE ENTRY DATE: 2019-04-01
  ref <313>: RELEVANT RESIDUES IN SEQ ID NO: (1)..(275)
ttttattggagagtttgatcctggctcaggacgaacgctggcggcgtgcctaatacatgcaagtcgagcggagtcgatgaggagcttgcttctctgagacttagcggcggacgggtgagtaacacgtaggtaacctgcccataagactgggataactaccggaaacggtagctaataccggataggttcttctctcgcatgggagaggaaagaaagacggagcaatctgtcacttatggatggacctgcggcgcattagctagttggtggggtaa

SEQ ID NO: 752 - DNA, 1557 bp, Paenibacillus sp. 598K
  ref <308>: DATABASE ACCESSION NUMBER: NCBI ACCESSION: NZ_BFBX01000174.1
  ref <309>: DATABASE ENTRY DATE: 2019-04-01
  ref <313>: RELEVANT RESIDUES IN SEQ ID NO: (1)..(1557)
atggagagtttgatcctggctcaggacgaacgctggcggcgtgcctaatacatgcaagtcgagcggggtcggatggaacttgttccatccagcctagcggcggacgggtgagtaacacgtaggcaacctgcctgcaagcctgggataactgcgggaaaccgcagctaataccggatacgcaattgggatgcatgtcctgattgggaaaggcggagcaatctgtcgcttgtagatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaggaaggccttcgggtcgtaaagctctgttgccagggaagaatgtcgaggagagtaactgctcttcgaatgacggtacctgagaagaaagccccggctaactacgtgccagcagccgcggtaatacgtagggggcaagcgttgtccggaattattgggcgtaaagcgcgcgcaggcggctttgtaagtctggtgtttaaacctggggctcaacctcgggtcgcattggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgaccggttcagagatgagcctttccttcgggacagaggagacaggtggtgcatggttgtcgtcagctcgtgtcgtgagatgttgggttaagtcccgcaacgagcgcaacccttgatcttagttgccagcacttcgggtgggcactctaggatgactgccggtgacaaaccggaggaaggtggggatgacgtcaaatcatcatgccccttatgacctgggctacacacgtactacaatggccggtacaacgggtcgcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaagga

SEQ ID NO: 753 - DNA, 1342 bp, Paenibacillus sp. 7197
  ref <308>: DATABASE ACCESSION NUMBER: NCBI ACCESSION: NZ_RQPI01000034.1
  ref <309>: DATABASE ENTRY DATE: 2019-04-01
  ref <313>: RELEVANT RESIDUES IN SEQ ID NO: (1)..(1342)
atctgctaccaggggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctgtttaagtctggtgtttaaaccatgggctcaacctgtggtcgcactggaaactgggcagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatatcctagagatagggtaggccttcgggacagaggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcttataaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 754 - DNA, 278 bp, Paenibacillus sp. 7516
  ref <308>: DATABASE ACCESSION NUMBER: NCBI ACCESSION: NZ_NPBI01000057.1
  ref <309>: DATABASE ENTRY DATE: 2019-04-01
  ref <313>: RELEVANT RESIDUES IN SEQ ID NO: (1)..(278)
aaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccttgagagtaactgctcaaggagtgacggtacctgagaagaaagccccggctaactacgtgccagcagccgcggtaatacgtagggggcaagcg

SEQ ID NO: 755 - DNA, 535 bp, Paenibacillus sp. 7523-1
  ref <308>: DATABASE ACCESSION NUMBER: NCBI ACCESSION: NZ_NPBR01000038.1
  ref <309>: DATABASE ENTRY DATE: 2019-04-01
  ref <313>: RELEVANT RESIDUES IN SEQ ID NO: (1)..(535)
acggggacccgcacaagcagtggagtatgtggtttaattcgaagcaacgcgaagaaccttaccaggtcttgacatccctctgaccgtcctagagatagggctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggag

SEQ ID NO: 756 - DNA, 404 bp, Paenibacillus sp. 7541
  ref <308>: DATABASE ACCESSION NUMBER: NCBI ACCESSION: NZ_NQLZ01000080.1
  ref <309>: DATABASE ENTRY DATE: 2019-04-01
  ref <313>: RELEVANT RESIDUES IN SEQ ID NO: (1)..(404)
ctttattggagagtttgatcctggctcaggacgaacgctggcggcgtgcctaatacatgcaagtcgagcggaatcgatggagtgcttgcactcctgagatttagcggcggacgggtgagtaacacgtaggcaacctgccctcaagactgggataactaccggaaacggtagctaataccggataggatatttggctgcatggccggatatggaaaggcggagcaatctgtcacttgaggatgggcctgcggcgcattagctagttggtggggtaatggcctaccaaggcgacgatgcgtagccgacctgagagggtgaacggccacactgggactgagacacggcccagactcctacgggaggcagcagtagggaatcttccgcaatggacgaaagtctgacgg

SEQ ID NO: 757 - DNA, 1081 bp, Paenibacillus sp. A9
  ref <308>: DATABASE ACCESSION NUMBER: NCBI ACCESSION: NZ_AOIG01000053.1
  ref <309>: DATABASE ENTRY DATE: 2019-04-01
  ref <313>: RELEVANT RESIDUES IN SEQ ID NO: (1)..(1081)
tccgagtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccgaagctcaacttcgggtcgcatcggaaactggatgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtaccttttcttcggaacattcaagacaggtggtgcatggttgtcgtcagctcgtgtcgtgagatgttgggttaagtcccgcaacgagcgcaacccttatgcttagttgccagcacatgatggtgggcactctaagcagactgccggtgacaaaccggaggaaggtggggatgacgtcaaatcatcatgccccttatgacctgggctacacacgtactacaatggtcggtacaacgggaagcgaagccgcgaggtggagcgaatcctaaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 758 - DNA, 1472 bp, Paenibacillus sp. AR247
  ref <308>: DATABASE ACCESSION NUMBER: NCBI ACCESSION: NZ_PCZT01000023.1
  ref <309>: DATABASE ENTRY DATE: 2019-04-01
  ref <313>: RELEVANT RESIDUES IN SEQ ID NO: (1)..(1472)
cctgatggttagcggcggacgggtgagtaacacgtaggcaacctgcctgcaagaccgggataacccacggaaacgtgagctaataccggatatctcatttcctctcctgaggagatgatgaaagacggagcaatctgtcacttgcggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccgatagagtaactgctatcggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaggccaaggctcaaccttggttcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttgattttagttgccagcacttcgggtgggcactctagaatgactgccggtgacaaaccggaggaaggcggggatgacgtcaaatcatcatgccccttatgacctgggctacacacgtactacaatggccagtacaacgggaagcgaagccgcgaggtggagccaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 759 - DNA, 534 bp, Paenibacillus sp. Aloe-11
  ref <308>: DATABASE ACCESSION NUMBER: NCBI ACCESSION: NZ_JH601072.1
  ref <309>: DATABASE ENTRY DATE: 2019-04-01
  ref <313>: RELEVANT RESIDUES IN SEQ ID NO: (1)..(534)
tttattggagagtttgatcctggctcaggacgaacgctggcggcgtgcctaatacatgcaagtcgagcgggattatttagaagcttgcttctaaataatctagcggcggacgggtgagtaacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgcttgggagagtaactgctcttgaggtgactgtacctgagaagaaagccccggctaactacgtgccagca

SEQ ID NO: 760 - DNA, 1138 bp, Paenibacillus sp. BC26
  ref <308>: DATABASE ACCESSION NUMBER: NCBI ACCESSION: NZ_FPAD01000013.1
  ref <309>: DATABASE ENTRY DATE: 2019-04-01
  ref <313>: RELEVANT RESIDUES IN SEQ ID NO: (1)..(1138)
cttttatggagagtttgatcctggctcaggacgaacgctggcggcgtgcctaatacatgcaagtcgagcggagttattccttcggggatagcttagcggcggacgggtgagtaacacgtaggcaacctgcctgtaagaccgggataacattcggaaacgaatgctaataccggatatgcaatttagctgcatggctgaattgggaaagacggtgcaagctgtcacttacagatgggcctgcggtgcattagctagttggtgaggtaacggctcaccaaggcgacgatgcatagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacagctaggcgagtaactgcgcttagaatgacggtacctgagaagaaagccccggctaactacgtgccagcagccgcggtaatacgtagggggcaagcgttgtccggaattattgggcgtaaagcgcgcgcaggcggctttgtaagtctagtgtttaatctcggagctcaactccgattcgcaccggaaactgcaaggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccagctcttgacatccctctgaatcacctagagataggtgcggccttcgggacagaggagacaggtggtgcatggttgtcgtcagctcgtgtcgtgagatgttgggttaagtcccgcaacgagcgcaacccctaattttagttgccagcac

SEQ ID NO: 761 - DNA, 1016 bp, Paenibacillus sp. BGI2013
  ref <308>: DATABASE ACCESSION NUMBER: NCBI ACCESSION: NZ_PJFA01000014.1
  ref <309>: DATABASE ENTRY DATE: 2019-04-01
  ref <313>: RELEVANT RESIDUES IN SEQ ID NO: (1)..(1016)
tttattggagagtttgatcctggctcaggacgaacgctggcggcatgcctaatacatgcaagtcgagcggacttgaagagaagcttgcttctctgatggttagcggcggacgggtgagtaacacgtaggcaacctgccctcaagtttgggacaactaccggaaacggtagctaataccgaataattgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctga

SEQ ID NO: 762 - DNA, 1559 bp, Paenibacillus sp. BIHB4019
  ref <308>: DATABASE ACCESSION NUMBER: NCBI ACCESSION: NZ_CP016808.1
  ref <309>: DATABASE ENTRY DATE: 2019-04-01
  ref <313>: RELEVANT RESIDUES IN SEQ ID NO: (1)..(1559)
atggagagtttgatcctggctcaggacgaacgctggcggcgtgcctaatacatgcaagtcgagcggacttgaaggagtgcttgcactcctgatggttagcggcggacgggtgagtaacacgtaggtaacctgcccgtaagactgggataacattcggaaacgaatgctaataccggatacacaacttggtcgcatgatcggagttgggaaagacggagtaatctgtcacttacggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgctaaggagagtaactgctctttaggtgacggtacctgagaagaaagccccggctaactacgtgccagcagccgcggtaatacgtagggggcaagcgttgtccggaattattgggcgtaaagcgcgcgcaggcggccttgtaagtctgttgtttcaggcacaagctcaacttgtgttcgcaatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaatctgctagagatagcagcggccttcgggacagaggagacaggtggtgcatggttgtcgtcagctcgtgtcgtgagatgttgggttaagtcccgcaacgagcgcaacccttgatcttagttgccagcaggttaagctgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 763 - DNA, 1569 bp, Paenibacillus sp. CAA11
  ref <308>: DATABASE ACCESSION NUMBER: NCBI ACCESSION: NZ_CP028922.1
  ref <309>: DATABASE ENTRY DATE: 2019-04-01
  ref <313>: RELEVANT RESIDUES IN SEQ ID NO: (1)..(1569)
cctttaatggagagtttgatcctggctcaggacgaacgctggcggcgtgcctaatacatgcaagtcgagcggagttatttagaagcttgcttctaaataacttagcggcggacgggtgagtaacacgtaggcaacctgcctgtaagactgggataactaccggaaacggtagctaataccggatacacaagttcctcgcatgagggatttgggaaagacggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttgagagagtaactgctcttgaggtgacggtacctgagaagaaagccccggctaactacgtgccagcagccgcggtaatacgtagggggcaagcgttgtccggaattattgggcgtaaagcgcgcgcaggcggccatttaagtctggtgtttaatcctggagctcaactccgggtcgcactggaaactgggtggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttcctttacggacagaggagacaggtggtgcatggttgtcgtcagctcgtgtcgtgagatgttgggttaagtcccgcaacgagcgcaacccttaactttagttgccagcaggtcaagctgggcactctagagtgactgccggtgacaaaccggaggaaggtggggatgacgtcaaatcatcatgccccttatgacctgggctacacacgtactacaatggccggtacaacgggaagcgaaggagcgatctggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaacccgcaagggggccagccgccgaaggtggggtagacgattggggtgaagtcgtaacaaggtagccgtatcggaaggtgcggctggatcacctcctttctatggaga

SEQ ID NO: 764 - DNA, 1358 bp, Paenibacillus sp. CF095
  ref <308>: DATABASE ACCESSION NUMBER: NCBI ACCESSION: NZ_FMZN01000015.1
  ref <309>: DATABASE ENTRY DATE: 2019-04-01
  ref <313>: RELEVANT RESIDUES IN SEQ ID NO: (1)..(1358)
aactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtaccttttcttcggaacattcaagacaggtggtgcatggttgtcgtcagctcgtgtcgtgagatgttgggttaagtcccgcaacgagcgcaacccttatatttagttgccagcatttcggatgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 765 - DNA, 286 bp, Paenibacillus sp. CF384
  ref <308>: DATABASE ACCESSION NUMBER: NCBI ACCESSION: NZ_FNNV01000025.1
  ref <309>: DATABASE ENTRY DATE: 2019-04-01
  ref <313>: RELEVANT RESIDUES IN SEQ ID NO: (1)..(286)
ttttatggagagtttgatcctggctcaggacgaacgctggcggcgtgcctaatacatgcaagtcgagcggagtcggatggaagcttgcttccatcctgcttagcggcggacgggtgagtaacacgtaggcaacctgcctgtaagaccgggataacattcggaaacgaatgctaataccggatatgcaattcagctgcatggctgaattgggaaagacggtgcaagctgtcacttacagatgggcctgcggtgcattagctagttggtggggtaacggctcaccaag

SEQ ID NO: 766 - DNA, 1563 bp, Paenibacillus sp. DCT19
  ref <308>: DATABASE ACCESSION NUMBER: NCBI ACCESSION: NZ_CP029639.1
  ref <309>: DATABASE ENTRY DATE: 2019-04-01
  ref <313>: RELEVANT RESIDUES IN SEQ ID NO: (1)..(1563)
tttattggagagtttgatcctggctcaggacgaacgctggcggcatgcctaatacatgcaagtcgagcggacttgaagagaagcttgcttctctgatggttagcggcggacgggtgagtaacacgtaggcaacctgccctcaagcttgggacaactaccggaaacggtagctaataccgaatagttgttttcttcgcctgaagagaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttaggagagtaactgctcctgaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtacctttccttcgggacattcaagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaaccgcgaggtggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 767 - DNA, 1555 bp, Paenibacillus sp. DMB5
  ref <308>: DATABASE ACCESSION NUMBER: NCBI ACCESSION: NZ_LRAC01000105.1
  ref <309>: DATABASE ENTRY DATE: 2019-04-01
  ref <313>: RELEVANT RESIDUES IN SEQ ID NO: (1)..(1555)
attggagagtttgatcctggctcaggacgaacgctggcggcgtgcctaatacatgcaagtcgagcggagcttatccttcggggtaagcttagcggcggacgggtgagtaacacgtaggcaacctgccccttagcctgggataactaccggaaacggtagctaataccggataatccctttcctcgcctgagggaaggatgaaaggcggagcaatctgtcgataagggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatcctctagagatagaggcggccttcgggacagaggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 768 - DNA, 1504 bp, Paenibacillus sp. DXL2
  ref <308>: DATABASE ACCESSION NUMBER: NCBI ACCESSION: NZ_QJVJ01000035.1
  ref <309>: DATABASE ENTRY DATE: 2019-04-01
  ref <313>: RELEVANT RESIDUES IN SEQ ID NO: (1)..(1504)
tcagagtttgatcctggctcaggacgaacgctggcggcgtgcctaatacatgcaagtcgagcgggtctcttcggaggctagcggcggacgggtgagtaacacgtaggcaacctgcccgtaagaccgggataacgttcggaaacgaacgctaataccggataggtggagaggaggcatcttctttcctggaaaggcggagcaatctgccacttacggatgggcctgcggcgcattagctagttggcggggtaacggcccaccaaggcgacgatgcgtagccgacctgagagggtgattggccacactgggactgagacacggcccagactcctacgggaggcagcagtagggaatcttccgcaatgggcgaaagcctgacggagcaacgccgcgtgagtgatgaaggttttcggatcgtaaagctctgttgccagagaagaacagtgcggagagtaactgctccgcatgtgacggtatctgagaagaaagccccggctaactacgtgccagcagccgcggtaatacgtagggggcaagcgttgtccggaattattgggcgtaaagcgcgcgcaggcggcgatttaagtctggtgtttaagcccggggctcaaccccggttcgcactggaaactggatggcttgagtgcaggagagggaagtggaattccacgtgtagcggtgaaatgcgtagagatgtggaggaacaccagtggcgaaggcgacttcctggcctgtaactgacgctgaggcgcgaaagcgtggggagcaaacaggattagataccctggtagtccacgccgtaaacgatgagtgctaggtgttaggggtttcgatacccttggtgccgaagtcaacacagtaagcactccgcctggggagtacggtcgcaagactgaaactcaaaggaattgacggggacccgcacaagcagtggagtatggtggtttaattcgaagcaacgcgaagaaccttaccaggtcttgacatcctcttgaatgtcccagagatggggcaggccttcgggacaagagagacaggtggtgcatggttgtcgtcagctcgtgtcgtgagatgttgggttaagtcccgcaacgagcgcaacccttgatcttagttgccagcaccttgggtgggcactctaggatgactgccggtgacaaaccggaggaaggcggggatgacgtcaaatcatcatgccccttatgacctgggctacacacgtactacaatggccggtacaacgggcagcgaagccgcgaggcggagccaatccttaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtaaccgttg

SEQ ID NO: 769 - DNA, 1565 bp, Paenibacillus sp. EZ-K15
  ref <308>: DATABASE ACCESSION NUMBER: NCBI ACCESSION: NZ_PDHM01000011.1
  ref <309>: DATABASE ENTRY DATE: 2019-04-01
  ref <313>: RELEVANT RESIDUES IN SEQ ID NO: (1)..(1565)
tttattggagagtttgatcctggctcaggacgaacgctggcggcgtgcctaatacatgcaagtcgagcggacttgatggagtgcttgcactcctgagagttagcggcggacgggtgagtaacacgtaggcaacctgccctcaagactgggataactaccggaaacggtagctaataccggataatttatttcgcagcattgtggaataatgaaagacggagcaatctgtcacttggggatgggcctgcggcgcattagctagttggtggggtaatggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactgggggacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcactttgggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccttacgggagccagccgccgaaggtggggtagatgattggggtgaagtcgtaacaaggtagccgtatcggaaggtgcggctggatcacctcctttctatggaga

SEQ ID NO: 770 - DNA, 1565 bp, Paenibacillus sp. F4
  ref <308>: DATABASE ACCESSION NUMBER: NCBI ACCESSION: NZ_POVS01000002.1
  ref <309>: DATABASE ENTRY DATE: 2019-04-01
  ref <313>: RELEVANT RESIDUES IN SEQ ID NO: (1)..(1565)
ttaatggagagtttgatcctggctcaggacgaacgctggcggcgtgcctaatacatgcaagtcgagcggggttgtttagaagcttgcttctaaacaatctagcggcggacgggtgagtaacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaatcgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 771 - DNA, 1562 bp, Paenibacillus sp. FW100M-2
  ref <308>: DATABASE ACCESSION NUMBER: NCBI ACCESSION: NZ_CP035492.1
  ref <309>: DATABASE ENTRY DATE: 2019-04-01
  ref <313>: RELEVANT RESIDUES IN SEQ ID NO: (1)..(1562)
cttttatggagagtttgatcctggctcaggacgaacgctggcggcgtgcctaatacatgcaagtcgagcggagtggaagaggtgcttgcacctctgaagcttagcggcggacgggtgagtaacacgtaggtaacctgcctgtaagaccgggataacattcggaaacggatgctaataccggatacgcaattctctcgcatgagggaattgggaaagacggagcaatctgtcacttacagatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgcttaggagagtaactgctcctgaggtgacggtacctgagaagaaagccccggctaactacgtgccagcagccgcggtaatacgtagggggcaagcgttgtccggaattattgggcgtaaagcgcgcgcaggcggtttattaagtctggtgtttaaggctggggctcaaccctggttcgcactggaaactggtagacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatcccgatgaaagcactagagatagtgtccctcttcggagcattggagacaggtggtgcatggttgtcgtcagctcgtgtcgtgagatgttgggttaagtcccgcaacgagcgcaacccttgatcttagttgccagcacttcgggtgggcactctaggatgactgccggtgacaaaccggaggaaggtggggatgacgtcaaatcatcatgccccttatgacctgggctacacacgtactacaatggccagtacaacgggaagcgaaggagcgatctggagccaatcctagcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 772 - DNA, 748 bp, Paenibacillus sp. GM1FR
  ref <308>: DATABASE ACCESSION NUMBER: NCBI ACCESSION: NZ_MKZL01000057.1
  ref <309>: DATABASE ENTRY DATE: 2019-04-01
  ref <313>: RELEVANT RESIDUES IN SEQ ID NO: (1)..(748)
gttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatc

SEQ ID NO: 773 - DNA, 1286 bp, Paenibacillus sp. GM2FR
  ref <308>: DATABASE ACCESSION NUMBER: NCBI ACCESSION: NZ_MKZM01000016.1
  ref <309>: DATABASE ENTRY DATE: 2019-04-01
  ref <313>: RELEVANT RESIDUES IN SEQ ID NO: (1)..(1286)
caccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactgggggacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcacttcgggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccttacgggagccagccgccgaaggtggggtagatgattggggtgaagtcgtaacaaggtagccgtatcggaaggtgcggctggatcacctcctttctatggaga

SEQ ID NO: 774 - DNA, 1557 bp, Paenibacillus sp. GP183
  ref <308>: DATABASE ACCESSION NUMBER: NCBI ACCESSION: NZ_FNSW01000001.1
  ref <309>: DATABASE ENTRY DATE: 2019-04-01
  ref <313>: RELEVANT RESIDUES IN SEQ ID NO: (1)..(1557)
tttattggagagtttgatcctggctcaggacgaacgctggcggcgtgcctaatacatgcaagtcgagcggatttattccttcggggatgagtcagcggcggacgggtgagtaacacgtaggcaacctgcctgaaggatcgggataactatcggaaacgatagctaagaccgaataattggcactttcgcatgaaggtgccatgaaacacggagcaatctgtggcctttggatgggcctgcggcgcattagctagtaggtgaggtaacggctcacctaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacgagtcagagagtaactgctctggctgtgacggtataggagaagaaagccccggctaactacgtgccagcagccgcggtaatacgtagggggcaagcgttgtccggaattattgggcgtaaagcgcgcgcaggcggttcagtaagttggatgtttaaagccggggctcaaccccggtgcgcatccaaaactggtggacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttaggggtttcgatgcccttggtgccgaagttaacacagtaagcactccgcctggggagtacgctcgcaagagtgaaactcaaaggaattgacggggacccgcacaagcagtggagtatgtggtttaattcgaagcaacgcgaagaaccttaccaggtcttgacatccccctgaatagtttagagataagctaggccttcgggacaggggagacaggtggtgcatggttgtcgtcagctcgtgtcgtgagatgttgggttaagtcccgcaacgagcgcaacccttgatgttagttgccagcgagtaaggtcgggcactctaacgtgactgccggtgacaaaccggaggaaggtggggatgacgtcaaatcatcatgccccttatgacctgggctacacacgtactacaatggccggtacaacgggaagcgaaagagcgatctggagcgaatctttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 775 - DNA, 1565 bp, Paenibacillus sp. HGF5
  ref <308>: DATABASE ACCESSION NUMBER: NCBI ACCESSION: NZ_AEXS01000095.1
  ref <309>: DATABASE ENTRY DATE: 2019-04-01
  ref <313>: RELEVANT RESIDUES IN SEQ ID NO: (1)..(1565)
tttattggagagtttgatcctggctcaggacgaacgctggcggcgtgcctaatacatgcaagtcgagcggacttgatggagtgcttgcactcctgatggttagcggcggacgggtgagtaacacgtaggcaacctgccctcaagactgggataactaccggaaacggtagctaataccggataatttattttgcagcattgtggaataatgaaaggcggagcaatctgtcacttgaggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcactttgggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccttaggggagccagccgccgaaggtggggtagatgattggggtgaagtcgtaacaaggtagccgtatcggaaggtgcggctggatcacctcctttctatggaga

SEQ ID NO: 776 - DNA, 1562 bp, Paenibacillus sp. HGF7
  ref <308>: DATABASE ACCESSION NUMBER: NCBI ACCESSION: NZ_AFDH01000147.1
  ref <309>: DATABASE ENTRY DATE: 2019-04-01
  ref <313>: RELEVANT RESIDUES IN SEQ ID NO: (1)..(1562)
tttatcggagagtttgatcctggctcaggacgaacgctggcggcgtgcctaatacatgcaagtcgagcggacttgatgagaagcttgcttctctgagagttagcggcggacgggtgagtaacacgtaggcaacctgcctgtaagatcgggataactaccggaaacggtagctaagaccggataatcggtatctccgcatggggagatcgtgaaacacggagcaatctgtggcttacggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgccaaggagagtaactgctctttgggtgacggtacctgagaagaaagccccggctaactacgtgccagcagccgcggtaatacgtagggggcaagcgttgtccggaattattgggcgtaaagcgcgcgcaggcggttttttaagtctggtgtttaatcccgaggctcaacctcggttcgcaccggaaactgggagactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgcatgctaggtgttaggggtttcgatacccttggtgccgaagttaacacagtaagcatgccgcctggggagtacgctcgcaagagtgaaactcaaaggaattgacggggacccgcacaagcagtggagtatgtggtttaattcgaagcaacgcgaagaaccttaccaggtcttgacatccctctgaccggcttagagataagcctttccttcgggacagaggtgacaggtggtgcatggttgtcgtcagctcgtgtcgtgagatgttgggttaagtcccgcaacgagcgcaacccttgaacttagttgccagcaggttaagctgggcactctaagttgactgccggtgacaaaccggaggaaggcggggatgacgtcaaatcatcatgccccttatgacctgggctacacacgtactacaatggccggtacaacgggaagcgaaggagcgatctggagccaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatgga

SEQ ID NO: 777 - DNA, 1553 bp, Paenibacillus sp. ICGEB2008; identical to SEQ ID NO: 290
  ref <308>: DATABASE ACCESSION NUMBER: NCBI ACCESSION: NZ_AMQU01000039.1
  ref <309>: DATABASE ENTRY DATE: 2019-04-01
  ref <313>: RELEVANT RESIDUES IN SEQ ID NO: (1)..(1553)

SEQ ID NO: 778 - DNA, 1549 bp, Paenibacillus sp. JDR-2
  ref <308>: DATABASE ACCESSION NUMBER: NCBI ACCESSION: NC_012914.1
  ref <309>: DATABASE ENTRY DATE: 2019-04-01
  ref <313>: RELEVANT RESIDUES IN SEQ ID NO: (1)..(1549)
tggagagtttgatcctggctcaggacgaacgctggcggcgtgcctaatacatgcaagtcgagcggatcttgtccttcgggataaggttagcggcggacgggtgagtaacacgtgggtaacctgcccataagactgggataacattcggaaacgaatgctaataccggatacgcgaattggtcgcatggccgaatcgggaaaggcggagcaatctgccacttatggatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttgcgagagtaactgctcgtaaggtgacggtacctgagaagaaagccccggctaactacgtgccagcagccgcggtaatacgtagggggcaagcgttgtccggaattattgggcgtaaagcgcgcgcaggcggccttgtaagtctgtcgtttaaactcggagctcaacttcgagtcgcgatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggctttccttcgggacagaggagacaggtggtgcatggttgtcgtcagctcgtgtcgtgagatgttgggttaagtcccgcaacgagcgcaacccttgatcttagttgccagcactttaaggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 779 - DNA, 1566 bp, Paenibacillus sp. KCOM 3021
  ref <308>: DATABASE ACCESSION NUMBER: NCBI ACCESSION: NZ_RRCN01000001.1
  ref <309>: DATABASE ENTRY DATE: 2019-04-01
  ref <313>: RELEVANT RESIDUES IN SEQ ID NO: (1)..(1566)
atccttattggagagtttgatcctggctcaggacgaacgctggcggcgtgcctaatacatgcaagtcgagcggagttaatcgggagcttgctcctgattaacttagcggcggacgggtgagtaacacgtaggcaacctgcccgtaagaccgggataactaccggaaacggtagctaataccggataatcaagcttctcgcatgagaggcttgggaaaggcggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaagaaggttttcggatcgtaaagctctgttgccagggaagaacgtcttctggagtaactgccaggagagtgacggtacctgagaagaaagccccggctaactacgtgccagcagccgcggtaatacgtagggggcaagcgttgtccggaattattgggcgtaaagcgcgcgcaggcggctgtttaagtctggtgtttaatcctggggctcaactccgggtcgcactggaaactggatggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagtaaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtgcctttccttcgggacagaggagacaggtggtgcatggttgtcgtcagctcgtgtcgtgagatgttgggttaagtcccgcaacgagcgcaacccttgactttagttgccagcaagtgaagttgggcactctagagtgactgccggtgacaaaccggaggaaggtggggatgacgtcaaatcatcatgccccttatgacctgggctacacacgtactacaatggccggtacaacgggaagcgaaggagcgatctggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctatggag

SEQ ID NO: 780 - DNA, 893 bp, Paenibacillus sp. KS1
  ref <308>: DATABASE ACCESSION NUMBER: NCBI ACCESSION: NZ_MAIS01000267.1
  ref <309>: DATABASE ENTRY DATE: 2019-04-01
  ref <313>: RELEVANT RESIDUES IN SEQ ID NO: (1)..(893)
ttgatggagtgcttgcactcctgatagttagcggcggacgggtgagtaacacgtaggtaacctgcccataagactgggataacccacggaaacgtgagctaataccagataggcattttcctcgcatgagggagatgagaaaggcggagcaatctgccacttatggatggacctgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcctaggagagtaactgctcttagggtgacggtacctgagaagaaagccccggctaactacgtgccagcagccgcggtaatacgtagggggcgagcgttgtccggaattattgggcgtaaagcgcgcgcaggcggcaatgtaagttgggtgtttaaacctagggctcaaccttgggtcgcatccaaaactgcatagcttgagtacagaagaggaaagtggaattccacgtgtagctgtgaaatgcgtagaaatgtggaggaacaccagtggccaaggcgactttctgggctgtaactgacgctgaggcgcgaaagcgtggggagcaaacaggattagataccctggaagtccacgccgtaaactatgaatgctaggtgttaggggtttcgatacccttggtgccgaagttaacacattaagcgttccgcctggggagtacggtcgcaagaatgaaactcaaaggaattgacggggacccggacaagcagttgagtatgtgg

SEQ ID NO: 781 - DNA, 1484 bp, Paenibacillus sp. LAM7113
  ref <308>: DATABASE ACCESSION NUMBER: NCBI ACCESSION: NZ_RICA01000014.1
  ref <309>: DATABASE ENTRY DATE: 2019-04-01
  ref <313>: RELEVANT RESIDUES IN SEQ ID NO: (1)..(1484)
acagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttcta

SEQ ID NO: 782 - DNA, 786 bp, Paenibacillus sp. LK1
  ref <308>: DATABASE ACCESSION NUMBER: NCBI ACCESSION: NZ_PEII01000042.1
  ref <309>: DATABASE ENTRY DATE: 2019-04-01
  ref <313>: RELEVANT RESIDUES IN SEQ ID NO: (1)..(786)
atctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatc

SEQ ID NO: 783 - DNA, 1563 bp, Paenibacillus sp. M-152
  ref <308>: DATABASE ACCESSION NUMBER: NCBI ACCESSION: NZ_CP034141.1
  ref <309>: DATABASE ENTRY DATE: 2019-04-01
  ref <313>: RELEVANT RESIDUES IN SEQ ID NO: (1)..(1563)
ttaatggagagtttgatcctggctcaggacgaacgctggcggcgtgcctaatacatgcaagtcgagcgggattatttagaagcttgcttctaaataatctagcggcggacgggtgagtaacacgtaggcaacctgcccacaagacagggataactaccggaaacggtagctaatacccgatacatcctttttctgcatgggagaaggaggaaagacggagcaatctgtcacttgtggatgggcctgcggcgcattagctagttggtggggtaatggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagataggcctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaagccgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 784 - DNA, 1562 bp, Paenibacillus sp. MBLB1234
  ref <308>: DATABASE ACCESSION NUMBER: NCBI ACCESSION: NZ_CP034346.1
  ref <309>: DATABASE ENTRY DATE: 2019-04-01
  ref <313>: RELEVANT RESIDUES IN SEQ ID NO: (1)..(1562)
tttattggagagtttgatcctggctcaggacgaacgctggcggcgtgcctaatacatgcaagtcgagcggacttgatggagagcttgctctcctgatggttagcggcggacgggtgagtaacacgtaggtaacctgcctgtaagactgggataactagcggaaacgttagctaataccggataatttattttctcgcatggggagataatgaaagacggagcaatctgtcacttatagatggacctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaatcctaaggctcaaccttaggtcgcattggaaactgggtagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgtaacacctagagataggtgccctcttcggagcattcaagacaggtggtgcatggttgtcgtcagctcgtgtcgtgagatgttgggttaagtcccgcaacgagcgcaacccttgattttagttgccagcacttcgggtgggcactctagaatgactgccggtgacaaaccggaggaaggcggggatgacgtcaaatcatcatgccccttatgacctgggctacacacgtactacaatggctggtacaacgggaagcgaagtcgcgagatggagcgaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 785 - DNA, 1340 bp, Paenibacillus sp. MY03
  ref <308>: DATABASE ACCESSION NUMBER: NCBI ACCESSION: NZ_MXQD01000125.1
  ref <309>: DATABASE ENTRY DATE: 2019-04-01
  ref <313>: RELEVANT RESIDUES IN SEQ ID NO: (1)..(1340)
atcgggaaagacggagcaatctgtcactgttggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggttcattaagtctggtgtttaaggctggggctcaaccctggttcgcactggaaactggtggacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgactttccttcgggacagaggagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccagtacaacgggaagcgaactcgcgagagggagccaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttct

SEQ ID NO: 786 - DNA, 260 bp, Paenibacillus sp. MYb67
  ref <308>: DATABASE ACCESSION NUMBER: NCBI ACCESSION: NZ_PCOF01000005.1
  ref <309>: DATABASE ENTRY DATE: 2019-04-01
  ref <313>: RELEVANT RESIDUES IN SEQ ID NO: (1)..(260)
tttattggagagtttgatcctggctcaggacgaacgctggcggcatgcctaatacatgcaagtcgagcggacttgatgagaagcttgcttctctgatggttagcggcggacgggtgagtaacacgtaggcaacctgccctcaagtttgggacaactaccggaaacggtagctaataccgaataattgttttcttcgcctgaagggaactggaaagacggagcaatctgtcacttggggatgggcctgcggcgcattagct

SEQ ID NO: 787 - DNA, 1565 bp, Paenibacillus sp. Marseille-P3787
  ref <308>: DATABASE ACCESSION NUMBER: NCBI ACCESSION: NZ_LT985747.1
  ref <309>: DATABASE ENTRY DATE: 2019-04-01
  ref <313>: RELEVANT RESIDUES IN SEQ ID NO: (1)..(1565)
tttattggagagtttgatcctggctcaggacgaacgctggcggcgtgcctaatacatgcaagtcgagcggagtttttaaggtgcttgcactttaaaaacttagcggcggacgggtgagtaatacgtaggcaacctgccctgaagactgggataactaccggaaacggtggctaataccggataatttatttcgctgcatggcggaataataaaaggcggagcaatctgccacttgaggatgggcctacggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgcttaggagagtaactgctcctggggtgacggtacctgagaagaaagccccggctaactacgtgccagcagccgcggtaatacgtagggggcaagcgttgtccggaattattgggcgtaaagcgcgcgcaggcggctctttaagtctggtgtttaaacccgaggctcaacttcgggtcgcactggaaactggggagcttgagtgcagaagaggagagtggaattccacgtgtagcggtgaaatgcgtagatatgtggaggaacaccagtggcgaaggcgactctctgggctgtaactgacgctgaggcgcgaaagcgtgggtagcaaacaggattagataccctggtagtccacgccgtaaacgatgaatgctaggtgttaggggtttcgatacccttggtgccgaagtaaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcaggtagagctgggcactctaaggtgactgccggtgacaaaccggaggaaggtggggatgacgtcaaatcatcatgccccttatgccctgggctacacacgtactacaatggctggtacaacgggaagcgaagccgcgaggtggagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccctttagggagccagccgccgaaggtggggtagatgattggggtgaagtcgtaacaaggtagccgtatcggaaggtgcggctggatcacctcctttctatggaga

SEQ ID NO: 788 - DNA, 1559 bp, Paenibacillus sp. Mc5Re-14
  ref <308>: DATABASE ACCESSION NUMBER: NCBI ACCESSION: NZ_CVPD01000001.1
  ref <309>: DATABASE ENTRY DATE: 2019-04-01
  ref <313>: RELEVANT RESIDUES IN SEQ ID NO: (1)..(1559)
tggagagtttgatcctggctcaggacgaacgctggcggcgtgcctaatacatgcaagtcgagcgggattatttagaagcttgcttctaaataatctagcggcggacgggtgagtaacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaatggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggagagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaagccgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 789 - DNA, 318 bp, Paenibacillus sp. NFR01
  ref <308>: DATABASE ACCESSION NUMBER: NCBI ACCESSION: NZ_FOIK01000006.1
  ref <309>: DATABASE ENTRY DATE: 2019-04-01
  ref <313>: RELEVANT RESIDUES IN SEQ ID NO: (1)..(318)
cctttaatggagagtttgatcctggctcaggacgaacgctggcggcgtgcctaatacatgcaagtcgagcggagtttatccttcggggtaagcttagcggcggacgggtgagtaacacgtaggcaacctgccccatgaactgggataactaccggaaacggtagctaataccggataattcctcttttcgcctgaagggaggatgaaagacggagcaatctgtcatcacgggatgggcctgcggcgcattagctagttggtggggtaacggctcaccaaggcgacgatgcgtagccgacctgagagggtgaacggcca

SEQ ID NO: 790 - DNA, 915 bp, Paenibacillus sp. O199
  ref <308>: DATABASE ACCESSION NUMBER: NCBI ACCESSION: NZ_LGRP01000094.1
  ref <309>: DATABASE ENTRY DATE: 2019-04-01
  ref <313>: RELEVANT RESIDUES IN SEQ ID NO: (1)..(915)
gatagttagcggcggacgggtgagtaacacgtaggcaacctgccctcaagtttgggacaactaccggaaacggtagctaataccgaatagttgttttcttctcctgaagagaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatc

SEQ ID NO: 791 - DNA, 1358 bp, Paenibacillus sp. OK003
  ref <308>: DATABASE ACCESSION NUMBER: NCBI ACCESSION: NZ_FOBD01000041.1
  ref <309>: DATABASE ENTRY DATE: 2019-04-01
  ref <313>: RELEVANT RESIDUES IN SEQ ID NO: (1)..(1358)
aactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgatcggtacagagatgtatctttccttcgggacagaggagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 792 - DNA, 1469 bp, Paenibacillus sp. OK060
  ref <308>: DATABASE ACCESSION NUMBER: NCBI ACCESSION: NZ_FNFR01000026.1
  ref <309>: DATABASE ENTRY DATE: 2019-04-01
  ref <313>: RELEVANT RESIDUES IN SEQ ID NO: (1)..(1469)
gatggttagcggcggacgggtgagtaacacgtaggcaacctgccctcaagtttgggacaactaccggaaacggtagctaataccgaatagttgttttcttctcctgaagagaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtaccttttcttcggaacattcaagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 793 - DNA, 1357 bp, Paenibacillus sp. OK076
  ref <308>: DATABASE ACCESSION NUMBER: NCBI ACCESSION: NZ_FOCH01000019.1
  ref <309>: DATABASE ENTRY DATE: 2019-04-01
  ref <313>: RELEVANT RESIDUES IN SEQ ID NO: (1)..(1357)
aactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 794 - DNA, 1555 bp, Paenibacillus sp. OSY-SE
  ref <308>: DATABASE ACCESSION NUMBER: NCBI ACCESSION: NZ_ALKF01000176.1
  ref <309>: DATABASE ENTRY DATE: 2019-04-01
  ref <313>: RELEVANT RESIDUES IN SEQ ID NO: (1)..(1555)
acggagagtttgatcctggctcaggacgaacgctggcggcgtgcctaatacatgcaagtcgagcggagctgatggagtgcttgcactcctgatgcttagcggcggacgggtgagtaacacgtaggtaacctgcctgtgagactgggataactaccggaaacggtagctaataccggatagacattttcctcgcctgagggagatgggaaagacggagcaatctgtcacttgcagatggacctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgccagggagagtaactgctctctgggtgacggtacctgagaagaaagccccggctaactacgtgccagcagccgcggtaatacgtagggggcaagcgttgtccggaattattgggcgtaaagcgcgcgcaggcggtgatgtaagttgggtgtttaaacctagggctcaaccttgggtcgcatccaaaactgcatgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggctttccttcgggacagaggagacaggtggtgcatggttgtcgtcagctcgtgtcgtgagatgttgggttaagtcccgcaacgagcgcaacccttaactttagttgccagcattgagttgggcactctagagtgactgccggtgacaaaccggaggaaggtggggatgacgtcaaatcatcatgccccttatgacctgggctacacacgtactacaatggctggtacaacgggaagcgaagccgcgaggtgaagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctaagga

SEQ ID NO: 795 - DNA, 1356 bp, Paenibacillus sp. OV191
  ref <308>: DATABASE ACCESSION NUMBER: NCBI ACCESSION: NZ_QJTA01000072.1
  ref <309>: DATABASE ENTRY DATE: 2019-04-01
  ref <313>: RELEVANT RESIDUES IN SEQ ID NO: (1)..(1356)
cgggaaagatggagcaatctatcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaatgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggccttgtaagtctgttgtttaaacttggggctcaaccccaagtcgcaatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgctctagagatagggctttccttcgggacagaggagacaggtggtgcatggttgtcgtcagctcgtgtcgtgagatgttgggttaagtcccgcaacgagcgcaacccttgatcttagttgccagcactttgggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacccgcaagggggctagccgtcgaaggtggggtagatgattggggtgaagtcgtaacaaggtagccgtatcggaaggtgcggctggatcacctcctttctaagga

SEQ ID NO: 796 - DNA, 276 bp, Paenibacillus sp. OV219
  ref <308>: DATABASE ACCESSION NUMBER: NCBI ACCESSION: NZ_FOCJ01000003.1
  ref <309>: DATABASE ENTRY DATE: 2019-04-01
  ref <313>: RELEVANT RESIDUES IN SEQ ID NO: (1)..(276)
ttatggagagtttgatcctggctcaggacgaacgctggcggcgtgcctaatacatgcaagtcgagcggagttattccttcggggatagcttagcggcggacgggtgagtaacacgtaggcaacctgcctgtaagatcgggataacattcggaaacggatgctaataccggataaacaactgagctgcatggctgagttgggaaagacggtgcaagctgtcacttacagatgggcctgcggtgcattagctagttggtggggtaacggctcaccaag

SEQ ID NO: 797 - DNA, 1562 bp, Paenibacillus sp. PAMC 26794
  ref <308>: DATABASE ACCESSION NUMBER: NCBI ACCESSION: NZ_ANHX01000070.1
  ref <309>: DATABASE ENTRY DATE: 2019-04-01
  ref <313>: RELEVANT RESIDUES IN SEQ ID NO: (1)..(1562)
tttattggagagtttgatcctggctcaggacgaacgctggcggcatgcctaatacatgcaagtcgagcggacttgaagagaagcttgcttctctgatcgttagcggcggacgggtgagtaacacgtaggcaacctgccctcaagtttgggacaactaccggaaacggtagctaataccgaatagttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgatcgatgcagagatgtatctttccttcgggacagaggagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggag

SEQ ID NO: 798 - DNA, 1564 bp, Paenibacillus sp. PCH8
  ref <308>: DATABASE ACCESSION NUMBER: NCBI ACCESSION: NZ_PKQK01000001.1
  ref <309>: DATABASE ENTRY DATE: 2019-04-01
  ref <313>: RELEVANT RESIDUES IN SEQ ID NO: (1)..(1564)
tttattggagagtttgatcctggctcaggacgaacgctggcggcatgcctaatacatgcaagtcgagcggacttgaagagaagcttgcttctctgatggttagcggcggacgggtgagtaacacgtaggcaacctgccctcaagtttgggacaactaccggaaacggtagctaataccgaataattgttttcttcacctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgatcgatgcagagatgtatctttccttcgggacagaggagacaggtggtgcatggttgtcgtcagctcgtgtcgtgagatgttgggttaagtcccgcaacgagcgcaacccttatatttagttgccagcacatcatggtgggcactctagatagactgccggtgacaaaccggaggaaggtggggatgacgtcaaatcatcatgccccttatgacctgggctacacacgtactacaatggccagtacaacgggctgcgaaatcgcgagatggagccaatcccaacaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 799 - DNA, 1333 bp, Paenibacillus sp. RU15A
  ref <308>: DATABASE ACCESSION NUMBER: NCBI ACCESSION: NZ_RCCY01000007.1
  ref <309>: DATABASE ENTRY DATE: 2019-04-01
  ref <313>: RELEVANT RESIDUES IN SEQ ID NO: (1)..(1333)
cttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaggaaggccttcgggtcgtaaagctctgttgccagggaagaacgggtggaagagtaactgcttccgccatgacggtacctgagaagaaagccccggctaactacgtgccagcagccgcggtaatacgtagggggcaagcgttgtccggaattattgggcgtaaagcgcgcgcaggcggctttgtaagtccggtgtttaatcttggggctcaaccccaagtcgcacgggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacaataagcattccgcctggggagtacgctcgcaagagtgaaactcaaaggaattgacggggacccgcacaagcagtggagtatgtggtttaattcgaagcaacgcgaagaaccttaccaggtcttgacatccccctgaatctgctagagatagcagcggccttcgggacaggggagacaggtggtgcatggttgtcgtcagctcgtgtcgtgagatgttgggttaagtcccgcaacgagcgcaacccttgattttagttgccagcacctcgggtgggcactctagaatgactgccggtgacaaaccggaggaaggcggggatgacgtcaaatcatcatgccccttatgacctgggctacacacgtactacaatggccggtacaacgggccgcgaagccgcgaggcggagccaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 800 - DNA, 1465 bp, Paenibacillus sp. RU26A
  ref <308>: DATABASE ACCESSION NUMBER: NCBI ACCESSION: NZ_OBQL01000029.1
  ref <309>: DATABASE ENTRY DATE: 2019-04-01
  ref <313>: RELEVANT RESIDUES IN SEQ ID NO: (1)..(1465)
gttagcggcggacgggtgagtaacacgtaggcaacctgccctcaagtttgggacaactaccggaaacggtagctaataccgaatagttgttttcttctcctgaagagaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgatcggtacagagatgtatctttccttcgggacagaggagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 801 - DNA, 1465 bp, Paenibacillus sp. RU5M; identical to SEQ ID NO: 800
  ref <308>: DATABASE ACCESSION NUMBER: NCBI ACCESSION: NZ_OBQM01000029.1
  ref <309>: DATABASE ENTRY DATE: 2019-04-01
  ref <313>: RELEVANT RESIDUES IN SEQ ID NO: (1)..(1465)

SEQ ID NO: 802 - DNA, 1557 bp, Paenibacillus sp. RUD330
  ref <308>: DATABASE ACCESSION NUMBER: NCBI ACCESSION: NZ_CP022655.1
  ref <309>: DATABASE ENTRY DATE: 2019-04-01
  ref <313>: RELEVANT RESIDUES IN SEQ ID NO: (1)..(1557)
cctttatggagagtttgatcctggctcaggacgaacgctggcggcgtgcctaatacatgcaagtcgagcggatcttgtccttcgggacaaggttagcggcggacgggtgagtaacacgtaggcaacctgccctcaagactgggataacctccggaaacggatgctaataccggatatgcggtttctcctcctggagagatcgggaaagacggagcaatctgtcgcttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaggaaggccttcgggtcgtaaagctctgttgccagggaagaacgggtggaagagtaactgcttccgccatgacggtacctgagaagaaagccccggctaactacgtgccagcagccgcggtaatacgtagggggcaagcgttgtccggaattattgggcgtaaagcgcgcgcaggcggctttgtaagtccggtgtttaatcttggggctcaaccccaagtcgcacgggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacaataagcattccgcctggggagtacgctcgcaagagtgaaactcaaaggaattgacggggacccgcacaagcagtggagtatgtggtttaattcgaagcaacgcgaagaaccttaccaggtcttgacatccccctgaatctgctagagatagcagcggccttcgggacaggggagacaggtggtgcatggttgtcgtcagctcgtgtcgtgagatgttgggttaagtcccgcaacgagcgcaacccttgattttagttgccagcacctcgggtgggcactctagaatgactgccggtgacaaaccggaggaaggcggggatgacgtcaaatcatcatgccccttatgacctgggctacacacgtactacaatggccggtacaacgggccgcgaagccgcgaggcggagccaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 803 - DNA, 447 bp, Paenibacillus sp. SMB1
  ref <308>: DATABASE ACCESSION NUMBER: NCBI ACCESSION: NZ_QKRB01000031.1
  ref <309>: DATABASE ENTRY DATE: 2019-04-01
  ref <313>: RELEVANT RESIDUES IN SEQ ID NO: (1)..(447)
tgggcactctaagatgactgccggtgacaaaccggaggaaggtggggatgacgtcaaatcatcatgccccttatgacctgggctacacacgtactacaatggccgatacaacgggtcgcgaagccgcgaggcggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacctgaagcgtttcgcaagaaacgcacatcggaagcgatgctcaggagccagccgtcgaaggtggggtagatgattggggtgaagtcgtaacaaggtagccgtatcggaaggtgcggctggatcacctcctttctaagga

SEQ ID NO: 804 - DNA, 1563 bp, Paenibacillus sp. SSG-1
  ref <308>: DATABASE ACCESSION NUMBER: NCBI ACCESSION: NZ_MBRK01000001.1
  ref <309>: DATABASE ENTRY DATE: 2019-04-01
  ref <313>: RELEVANT RESIDUES IN SEQ ID NO: (1)..(1563)
tttcttggagagtttgatcctggctcaggacgaacgctggcggcgtgcctaatacatgcaagtcgagcggacttgatggagagcttgctctcctgatggttagcggcggacgggtgagtaacacgtaggcaacctgcctgcaagaccgggataacccacggaaacgtgagctaataccggatatctcatctcctctcctgaggggatgatgaaagacggagcaatctgtcacttgcggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaggccaaggctcaaccttggttcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttgattttagttgccagcacttcgggtgggcactctaaaatgactgccggtgacaaaccggaggaaggcggggatgacgtcaaatcatcatgccccttatgacctgggctacacacgtactacaatggccagtacaacgggaagcgaagccgcgaggtggagccaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 805 - DNA, 1417 bp, Paenibacillus sp. St-s
  ref <308>: DATABASE ACCESSION NUMBER: NCBI ACCESSION: NZ_FYER01000029.1
  ref <309>: DATABASE ENTRY DATE: 2019-04-01
  ref <313>: RELEVANT RESIDUES IN SEQ ID NO: (1)..(1417)
agactgggataacccacggaaacgtgagctaataccagataggcatcttcttcgcatgaaggagatgagaaagacggtttcggctgtcacttatggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgctcaggagagtaactgctcttgaggtgacggtacttgagaagaaagccccggctaactacgtgccagcagccgcggtaatacgtagggggcaagcgttgtccggaattattgggcgtaaagcgcgcgcaggcggcgatgtaagttgggtgtttaaacctagggctcaaccttgggtcgcatccaaaactgcatggcttgagtgcagcagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccgtcctagagatagggctttccttcgggacattcaagacaggtggtgcatggttgtcgtcagctcgtgtcgtgagatgttgggttaagtcccgcaacgagcgcaacccttaactttagttgccagcattaagttgggcactctagagtgactgccggtgacaaaccggaggaaggtggggatgacgtcaaatcatcatgccccttatgacctgggctacacacgtactacaatggtcggtacaacgggaagcgaagccgcgaggtggagccaatcctaaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttctaagga

SEQ ID NO: 806 - DNA, 948 bp, Paenibacillus sp. UNC496MF
  ref <308>: DATABASE ACCESSION NUMBER: NCBI ACCESSION: NZ_FORE01000002.1
  ref <309>: DATABASE ENTRY DATE: 2019-04-01
  ref <313>: RELEVANT RESIDUES IN SEQ ID NO: (1)..(948)
ccggaagagtaactgctttcggaatgacggtacctgagaagaaagccccggctaactacgtgccagcagccgcggtaatacgtagggggcaagcgttgtccggaattattgggcgtaaagcgcgcgcaggcggctttgtaagtttggtgtttaagctcggagctcaactccgatacgcatcgaaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccagctcttgacatccctctgaccggtctagagataggcctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgagctgggctacacacgtactacaatggccggtacaacgggaagcgaagccgcgaggtggagccaatccttacaagccggtctcagttcggattgcaggctgcaactcgcctgcatgaagtcggaattgctagtaatcgcggatcagcatgccgcggtgaatacgttcccgggtcttgtacacaccgcc

SEQ ID NO: 807 - DNA, 1332 bp, Paenibacillus sp. VMFN-D1
  ref <308>: DATABASE ACCESSION NUMBER: NCBI ACCESSION: NZ_QRDU01000016.1
  ref <309>: DATABASE ENTRY DATE: 2019-04-01
  ref <313>: RELEVANT RESIDUES IN SEQ ID NO: (1)..(1332)
cttgcggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccgatagagtaactgctatcggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaggccaaggctcaaccttggttcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttgattttagttgccagcacttcgggtgggcactctagaatgactgccggtgacaaaccggaggaaggcggggatgacgtcaaatcatcatgccccttatgacctgggctacacacgtactacaatggccagtacaacgggaagcgaagccgcgaggtggagccaatcctatcaaagctggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 808 - DNA, 920 bp, Paenibacillus sp. VTT E-133280
  ref <308>: DATABASE ACCESSION NUMBER: NCBI ACCESSION: NZ_NFUX01000163.1
  ref <309>: DATABASE ENTRY DATE: 2019-04-01
  ref <313>: RELEVANT RESIDUES IN SEQ ID NO: (1)..(920)
ttagcggcggacgggtgagtaacacgtaggcaacctgccccttagactgggataactaccggaaacggtagctaataccggataatttcttttttctcctgaagaaagaatgaaagacggagcaatctgtcactgagggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctgaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatc

SEQ ID NO: 809 - DNA, 1492 bp, Paenibacillus sp. VTT E-133291
  ref <308>: DATABASE ACCESSION NUMBER: NCBI ACCESSION: NZ_NFVA01000205.1
  ref <309>: DATABASE ENTRY DATE: 2019-04-01
  ref <313>: RELEVANT RESIDUES IN SEQ ID NO: (1)..(1492)
tttgaaagcttgctttcaaaataacttagcggcggacgggtgagtaacacgtaggcaacctgccccttagactgggataactaccggaaacggtagctaataccggataatttcttttttctcctgaagaaagaatgaaagacggagtaatctgtcactgagggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctgaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcggggcagaggagacaggtggtgcatggttgtcgtcagctcgtgtcgtgagatgttgggttaagtcccgcaacgagcgcaacccttaactttagttgccagcaagtaatgttgggcactctagagtgactgccggtgacaaaccggaggaaggtggggatgacgtcaaatcatcatgccccttatgacctgggctacacacgtactacaatggccggtacaacgggaagcgaaaccgcgaggtgaagccaatcccatcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 810 - DNA, 531 bp, Paenibacillus sp. XY044
  ref <308>: DATABASE ACCESSION NUMBER: NCBI ACCESSION: NZ_NQMO01000027.1
  ref <309>: DATABASE ENTRY DATE: 2019-04-01
  ref <313>: RELEVANT RESIDUES IN SEQ ID NO: (1)..(531)
cggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaggccaaggctcaaccttggttcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctga

SEQ ID NO: 811 - DNA, 1566 bp, Paenibacillus sp. Y412MC10
  ref <308>: DATABASE ACCESSION NUMBER: NCBI ACCESSION: NC_013406.1
  ref <309>: DATABASE ENTRY DATE: 2019-04-01
  ref <313>: RELEVANT RESIDUES IN SEQ ID NO: (1)..(1566)
tttattggagagtttgatcctggctcaggacgaacgctggcggcgtgcctaatacatgcaagtcgagcggacttgatggagtgcttgcactcctgaaggttagcggcggacgggtgagtaacacgtaggcaacctgccctcaagactgggataactaccggaaacggtagctaataccggataatttattttgcagcattgtggaataatgaaaggcggagcaatctgtcacttgaggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctagaagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcactttaaggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccttaggggagccagccgccgaaggtggggtagatgattggggtgaagtcgtaacaaggtagccgtatcggaaggtgcggctggatcacctcctttctatggaga

SEQ ID NO: 812 - DNA, 657 bp, Paenibacillus sp. YN15
  ref <308>: DATABASE ACCESSION NUMBER: NCBI ACCESSION: NZ_QMFA01000108.1
  ref <309>: DATABASE ENTRY DATE: 2019-04-01
  ref <313>: RELEVANT RESIDUES IN SEQ ID NO: (1)..(657)
aattattgggcgtaaagcgcgcgcaggcggttgtttaagtctggggtttaagttcggggctcaaccctgcaatcgccctggaaactggggaactggagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgtacgctaggtgttgggggtttcgataccctcggtgccgaagttaacacattaagcgtaccgcctggggagtacgctcgcaagagtgaaactcaaaggaattgacggggacccgcacaagcagtggagtatgtggtttaattcgaagcaacgcgaagaaccttaccaggtcttgacatcgggatgaccgcttcagagatggagctttccttcgggacatcccagacaggtggtgcatggttgtcgtcagctcgtgtcgtgagatgttgggttaagtcccgcaacgagcgcaacccttgatcttagttgccagcgcgtaatggtgggctctctaagatgactgccggtgacaaaccggaggaaggtggggatgacgtcaaatcatcatgcccctta

SEQ ID NO: 813 - DNA, 307 bp, Paenibacillus sp. cl123
  ref <308>: DATABASE ACCESSION NUMBER: NCBI ACCESSION: NZ_FMYY01000027.1
  ref <309>: DATABASE ENTRY DATE: 2019-04-01
  ref <313>: RELEVANT RESIDUES IN SEQ ID NO: (1)..(307)
tggagagtttgatcctggctcaggacgaacgctggcggcgtgcctaatacatgcaagtcgagcggatctgttccttcgggaataggttagcggcggacgggtgagtaacacgtaggcaacctgcctgtaagatcgggataactaccggaaacggtagctaagaccggatagctggtttcttcgcatggagagatcatgaaacatggggcaacctatgacttacagatgggcctgcggcgcattagctagttggcggggtaacggcccaccaaggcgacgatgcgtagccgacctgagagggtgatcg

SEQ ID NO: 814 - DNA, 277 bp, Paenibacillus sp. cl130
  ref <308>: DATABASE ACCESSION NUMBER: NCBI ACCESSION: NZ_FOYG01000011.1
  ref <309>: DATABASE ENTRY DATE: 2019-04-01
  ref <313>: RELEVANT RESIDUES IN SEQ ID NO: (1)..(277)
tctttaatggagagtttgatcctggctcaggacgaacgctggcggcgtgcctaatacatgcaagtcgagcggggctaagtagaagcttgcttctaaacaacctagcggcggacgggtgagtaacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaaa

SEQ ID NO: 815 - DNA, 310 bp, Paenibacillus sp. cl141a
  ref <308>: DATABASE ACCESSION NUMBER: NCBI ACCESSION: NZ_FNZO01000017.1
  ref <309>: DATABASE ENTRY DATE: 2019-04-01
  ref <313>: RELEVANT RESIDUES IN SEQ ID NO: (1)..(310)
tttattggagagtttgatcctggctcaggacgaacgctggcggcgtgcctaatacatgcaagtcgagcggacttgatggagtgcttgcactcctgaaggttagcggcggacgggtgagtaacacgtaggcaacctgccctcaagactgggataactaccggaaacggtagctaataccggataatttattttgcagcattgtgaaataatgaaaggcggagcaatctgtcacttgaggatgggcctgcggcgcattagctagttggtggggtaacggcccaccaaggcgacgatgcgtagccgacctgag

SEQ ID NO: 816 - DNA, 252 bp, Paenibacillus sp. cl6col
  ref <308>: DATABASE ACCESSION NUMBER: NCBI ACCESSION: NZ_FNAZ01000011.1
  ref <309>: DATABASE ENTRY DATE: 2019-04-01
  ref <313>: RELEVANT RESIDUES IN SEQ ID NO: (1)..(252)
tttaacggagagtttgatcctggctcaggacgaacgctggcggcgtgcctaatacatgcaagtcgagcggacttgatggagtgcttgcactcctgatggttagcggcggacgggtgagtaacacgtaggtaacctgcccataagactgggataacccacggaaacgtgagctaataccagataggcattttcctcgcatgagggagatgagaaaggcggagcaatctgccacttatggatggacctgcggcg

SEQ ID NO: 817 - DNA, 1563 bp, Paenibacillus sp. lzh-N1
  ref <308>: DATABASE ACCESSION NUMBER: NCBI ACCESSION: NZ_CP025696.1
  ref <309>: DATABASE ENTRY DATE: 2019-04-01
  ref <313>: RELEVANT RESIDUES IN SEQ ID NO: (1)..(1563)
ttaatggagagtttgatcctggctcaggacgaacgctggcggcgtgcctaatacatgcaagtcgagcgggattatttagaagcttgcttctaaataatctagcggcggacgggtgagtaacacgtaggcaacctgcccacaagacagggataactaccggaaacggtagctaatacccgatacatccttttcctgcatgggagaaggaggaaaggcggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctatgagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaagccgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagctgccgaaggtggggtagatgattggggtgaagtcgtaacaaggtagccgtatcggaaggtgcggctggatcacctcctttctatggaga

SEQ ID NO: 818 - DNA, 1075 bp, Paenibacillus sp. oral taxon 786
  ref <308>: DATABASE ACCESSION NUMBER: NCBI ACCESSION: NZ_GG696010.1
  ref <309>: DATABASE ENTRY DATE: 2019-04-01
  ref <313>: RELEVANT RESIDUES IN SEQ ID NO: (1)..(1075)
gagtgacggtacctgagaagaaagccccggctaactacgtgccagcagccgcggtaatacgtagggggcgagcgttgtccggaattattgggcgtaaagcgcgcgcaggcggctgtttaagtctggtgtttaatcctggggctcaaccccgggtcgcactggaaactggacggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggccgcaaggctgaaactcaaaggaattgacggggacccgcacaagcagtggagtatgtggtttaattcgaagcaacgcgaagaaccttaccaggtcttgacatccccctgaccggatcagagatgatcctttcctacgggacaggggagacaggtggtgcatggttgtcgtcagctcgtgtcgtgagatgttgggttaagtcccgcaacgagcgcaacccttgactttagttgccagcaggtcaggctgggcactctagagtgactgccggtgacaaaccggaggaaggtggggatgacgtcaaatcatcatgccccttatgacctgggctacacacgtactacaatggccggtacaacgggaagcgaaggagcgatctggagcgaatccttgaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggag

SEQ ID NO: 819 - DNA, 267 bp, Paenibacillus sp. yr247
  ref <308>: DATABASE ACCESSION NUMBER: NCBI ACCESSION: NZ_FNIF01000049.1
  ref <309>: DATABASE ENTRY DATE: 2019-04-01
  ref <313>: RELEVANT RESIDUES IN SEQ ID NO: (1)..(267)
tatggagagtttgatcctggctcaggacgaacgctggcggcgtgcctaatacatgcaagtcgagcgaacttatccttcgggataagttagcggcggacgggtgagtaacacgtaggtaacctgcctataagatcgggataactatcggaaacgatagctaagaccggataactggttttctcgcatgagagaactatgaaacacggagcaatctgtggcttatagatgggcctgcggcgcattagctagttggtagggtaacggcct

SEQ ID NO: 820 - DNA, 1537 bp, Paenibacillus taichungensis
  ref <308>: DATABASE ACCESSION NUMBER: NCBI ACCESSION: NZ_QEVW01000030.1
  ref <309>: DATABASE ENTRY DATE: 2019-04-01
  ref <313>: RELEVANT RESIDUES IN SEQ ID NO: (1)..(1537)
caggacgaacgctggcggcatgcctaatacatgcaagtcgagcggacttgaagagaagcttgcttctctgatggttagcggcggacgggtgagtaacacgtaggcaacctgccctcaagcttgggacaactaccggaaacggtagctaataccgaatagttgttttcttctcctgaagagaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 821 - DNA, 369 bp, Paenibacillus taihuensis
  ref <308>: DATABASE ACCESSION NUMBER: NCBI ACCESSION: NZ_QTTN01000014.1
  ref <309>: DATABASE ENTRY DATE: 2019-04-01
  ref <313>: RELEVANT RESIDUES IN SEQ ID NO: (1)..(369)
ccttttatggagagtttgatcctggctcaggacgaacgctggcggcgtgcctaatacatgcaagtcgagcggactttgccttcgggtaaggttagcggcggacgggtgagtaacacgtaggcaacctgcctgtaagaccgggataacattcggaaacgaatgctaataccggatacgcaacttgactgcatggtcgagttgggaaagacggcgcaagctgtcacttacagatgggcctgcggtgcattagctagttggtgaggtaacggctcaccaaggcgacgatgcatagccgacctgagagggtgatcggccacactgggactgagacacggcccagactcctacgggaggcagcagtagggaatc

SEQ ID NO: 822 - DNA, 1561 bp, Paenibacillus thiaminolyticus
  ref <308>: DATABASE ACCESSION NUMBER: NCBI ACCESSION: NZ_UGRZ01000006.1
  ref <309>: DATABASE ENTRY DATE: 2019-04-01
  ref <313>: RELEVANT RESIDUES IN SEQ ID NO: (1)..(1561)
cttttatggagagtttgatcctggctcaggacgaacgctggcggcgtgcctaatacatgcaagtcgagcggagcaacggtttccttcgggaagccattagcttagcggcggacgggtgagtaatacgtaggtaacctgcccttaagaccgggataactcacggaaacgtgggctaataccggatagtcgatttcctcgcatgagggaatcgggaaaggcggagcaatctgccacttatggatggacctacggcgcattagctagttggtggggtaacggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgctatggagagtaactgttccataggtgacggtacctgagaagaaagccccggctaactacgtgccagcagccgcggtaatacgtagggggcaagcgttgtccggaattattgggcgtaaagcgcgcgcaggcggtcatgtaagtctggtgtttaaacccggggctcaactccgggtcgcatcggaaactgtgtgacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtcctagagatagggcttcccttcggggcagaggtgacaggtggtgcatggttgtcgtcagctcgtgtcgtgagatgttgggttaagtcccgcaacgagcgcaacccttaactttagttgccagcattaagttgggcactctagagtgactgccggtgacaaaccggaggaaggtggggatgacgtcaaatcatcatgccccttatgacctgggctacacacgtactacaatggctggtacaacgggaagcgaagccgcgaggtggagcgaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctggatcacctcctttctaagga

SEQ ID NO: 823 - DNA, 304 bp, Paenibacillus tianmuensis
  ref <308>: DATABASE ACCESSION NUMBER: NCBI ACCESSION: NZ_FMTT01000031.1
  ref <309>: DATABASE ENTRY DATE: 2019-04-01
  ref <313>: RELEVANT RESIDUES IN SEQ ID NO: (1)..(304)
tggagagtttgatcctggctcaggacgaacgctggcggcgtgcctaatacatgcaagtcgagcgggctttgccttcgggtaaagctagcggcggacgggtgagtaacacgtaggcaacctgcctgtaaggctgggataactaccggaaacggtagctaagaccggataagtggtcttctcgcatgaggagatcaagaaacacggggcaacctgtggcttacagatgggcctgcggcgcattagctagttggtggggtaacggctcaccaaggcgacgatgcgtagccgacctgagagggtgatc

SEQ ID NO: 824 - DNA, 1558 bp, Paenibacillus tuaregi
  ref <308>: DATABASE ACCESSION NUMBER: NCBI ACCESSION: NZ_LT575476.1
  ref <309>: DATABASE ENTRY DATE: 2019-04-01
  ref <313>: RELEVANT RESIDUES IN SEQ ID NO: (1)..(1558)
tggagagtttgatcctggctcaggacgaacgctggcggcgtgcctaatacatgcaagtcgagcggacttgatggagagcttgctctccagagagttagcggcggacgggtgagtaacacgtaggtaacctgcctgtaagactgggataactaccggaaacggtagctaataccggatacgcaagtttctcgcatgagggatttgggaaagacggagcaatctgtcacttatggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggctatgtaagtctggtgtttaaccccggagctcaacttcgggtcgcactggaaactggatagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatcccgatgaaagctctagagatagagtccctcttcggagcatcggtgacaggtggtgcatggttgtcgtcagctcgtgtcgtgagatgttgggttaagtcccgcaacgagcgcaacccttgattttagttgccagcacttcgggtgggcactctagaatgactgccggtgacaaaccggaggaaggcggggatgacgtcaaatcatcatgccccttatgacttgggctacacacgtactacaatggccggtacaacgggaagcgaagtcgcgagatggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 825 - DNA, 1557 bp, Paenibacillus typhae
  ref <308>: DATABASE ACCESSION NUMBER: NCBI ACCESSION: NZ_FNDX01000092.1
  ref <309>: DATABASE ENTRY DATE: 2019-04-01
  ref <313>: RELEVANT RESIDUES IN SEQ ID NO: (1)..(1557)
ttattggagagtttgatcctggctcaggacgaacgctggcggcgtgcctaatacatgcaagtcgagcggagtttatccttcggggtaagcttagcggcggacgggtgagtaacacgtaggcaacctgccccttagcctgggataactaccggaaacggtagctaataccggataatccctttcctcgcctgaggaaaggataaaaggcggagcaatctgctgataagggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatcctctagagatagaggcggccttcgggacagaggagacaggtggtgcatggttgtcgtcagctcgtgtcgtgagatgttgggttaagtcccgcaacgagcgcaacccttgactttagttgccagcaggttaagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtggggtagatgattggggtgaagtcgtaacaaggtagccgtatcggaaggtgcggctggatcacctcctttctatggaga

SEQ ID NO: 826 - DNA, 1459 bp, Paenibacillus validus
  ref <308>: DATABASE ACCESSION NUMBER: NCBI ACCESSION: NZ_BIMH01000118.1
  ref <309>: DATABASE ENTRY DATE: 2019-04-01
  ref <313>: RELEVANT RESIDUES IN SEQ ID NO: (1)..(1459)
agcggcggacgggtgagtaacacgtaggcaacctgcctgtaagatcgggataactaccggaaacggtagctaagaccggatagctggtttctccgcatgggggaatcatgaaacatggggcaacctatggcttacggatgggcctgcggcgcattagctagttggtggggtaatggcccaccaaggcgacgatgcgtagccgacctgagagggtgatcggccacactgggactgagacacggcccagactcctacgggaggcagcagtagggaatcttccgcaatgggcgcaagcctgacggagcaacgccgcgtgagtgatgaaggttttcggatcgtaaagctctgttgccaaggaagaacgcctcggagagtaactgctctgagggtgacggtacttgagaagaaagccccggctaactacgtgccagcagccgcggtaatacgtagggggcaagcgttgtccggaattattgggcgtaaagcgcgcgcaggcggtcttttaagtttggtgtttaagcccggggctcaaccccggttcgcactgaaaactgggagacttgagtgcaggagaggaaagcggaattccacgtgtagcggtgaaatgcgtagagatgtggaggaacaccagtggcgaaggcggctttctggactgtaactgacgctgaggcgcgaaagcgtggggagcaaacaggattagataccctggtagtccacgccgtaaacgatgagtgctaggtgttaggggtttcgatacccttggtgccgaagtaaacacaataagcactccgcctggggagtacgctcgcaagagtgaaactcaaaggaattgacggggacccgcacaagcagtggagtatgtggtttaattcgaagcaacgcgaagaaccttaccaggtcttgacatccctctgaccggtacagagatgtaccttcccttcggggcagaggagacaggtggtgcatggttgtcgtcagctcgtgtcgtgagatgttgggttaagtcccgcaacgagcgcaacccttgaacttagttgccagcattcagttgggcactctaagttgactgccggtgacaaaccggaggaaggtggggatgacgtcaaatcatcatgccccttatgacctgggctacacacgtactacaatggccggtacaacgggaagcgaagtcgcgagatggagcgaatccttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagccagccgccgaaggtggggtagatgattggggtgaagtcgtaacaaggtagccgtatcggaaggtgcggctggatcacctcctttctatggag

SEQ ID NO: 827 - DNA, 1535 bp, Paenibacillus vortex
  ref <308>: DATABASE ACCESSION NUMBER: NCBI ACCESSION: NZ_ADHJ01000002.1
  ref <309>: DATABASE ENTRY DATE: 2019-04-01
  ref <313>: RELEVANT RESIDUES IN SEQ ID NO: (1)..(1535)
gaacgctggcggcgtgcctaatacatgcaagtcgagcggacttgatggagtgcttgcactcctgatagttagcggcggacgggtgagtaacacgtaggcaacctgccctcaagactgggataactaccggaaacggtagctaataccggataatttatttcatagcattgtgtgataatgaaagacggagcaatctgtcacttggggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtctcatagagtaactgctatgagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacctggggctcaacttcaggtcgcactggaaactgggggacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatctgctagagatagtagcggccttcgggacagaggagacaggtggtgcatggttgtcgtcagctcgtgtcgtgagatgttgggttaagtcccgcaacgagcgcaacccttgattttagttgccagcaggtaaggctgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 828 - DNA, 1357 bp, Paenibacillus whitsoniae
  ref <308>: DATABASE ACCESSION NUMBER: NCBI ACCESSION: NZ_RXHU01000130.1
  ref <309>: DATABASE ENTRY DATE: 2019-04-01
  ref <313>: RELEVANT RESIDUES IN SEQ ID NO: (1)..(1357)
atcatgaaacacggagcaatctgtggcttgaagatgggcctgcggcgcattagctagttggtagggtaacggcctaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccctagacgaacagcatcaggagtaactgcctggtgtgtgacggtataggagaagaaagccccggctaactacgtgccagcagccgcggtaatacgtagggggcaagcgttgtccggaattattgggcgtaaagcgcgcgcaggcggttcgttaagttgggtgtttaagcccggggctcaaccccggttcgcatccaaaactggcggacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatactaggtgtcggggattcgatttctcggtgccgaagtcaacacagtaagtatgccgcctggggagtacgctcgcaagagtgaaactcaaaggaattgacggggacccgcacaagcagtggagtatgtggtttaattcgaagcaacgcgaagaaccttaccaggtcttgacatccctctgaatcctctagagatagaggcggccttcgggacagaggagacaggtggtgcatggttgtcgtcagctcgtgtcgtgagatgttgggttaagtcccgcaacgagcgcaacccttgatcttagttgccagcacttcgggtgggcactctaggatgactgccggtgacaaaccggaggaaggtggggatgacgtcaaatcatcatgccccttatgacctgggctacacacgtactacaatggtcggtacaacgggaagcgaagccgcgaggtggagcgaatcctaaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggggccagccgccgaaggtggggtagatgattggggtgaagtcgtaacaaggtagccgtatcggaaggtgcggctggatcacctcctttctatggaga

SEQ ID NO: 829 - DNA, 1060 bp, Paenibacillus xerothermodurans
  ref <308>: DATABASE ACCESSION NUMBER: NCBI ACCESSION: NZ_NHRJ02000032.1
  ref <309>: DATABASE ENTRY DATE: 2019-04-01
  ref <313>: RELEVANT RESIDUES IN SEQ ID NO: (1)..(1060)
catgaaacacggagcaatctgtggcttacagatgggcctgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaatgyttaagggagtaactgcccttaaggtgacggtacctgagaagaaagccccggctaactacgtgccagcagccgcggtaatacgtagggggcaagcgttgtccggaattattgggcgtaaagcgcgcgcaggcggtgatttaagtttggtgttctggaccgtaactgacgctgaggcgcgaaagcgtggggagcaaacaggattagataccctggtagtccacgccgtaaacgatgagtgctaggtgttaggggtttcgatacccttggtgccgaagtaaacacagtaagcactccgcctggggagtacgctcgcaagagtgaaactcaaaggaattgacggggacccgcacaagcagtggagtatgtggtttaattcgaagcaacgcgaagaaccttaccaggtcttgacatccctctgaatacgttagagataacgtcggccytcgggacagaggtgacaggtggtgcatggttgtcgtcagctcgtgtcgtgagatgttgggttaagtcccgcaacgagcgcaacccttgattctagttgccagcattgagttgggcactctagagtgactgccggtgacaaaccggaggaaggtggggatgacgtcaaatcatcatgccccttatgacctgggctacacacgtactacaatggccggtacaacgggaagcgaaaccgcgaggtggagcgaatctttacaagccggtctcagttcggattgcaggctgcaactcgcctgcatgaagtcggaattgctagtaatcgcggatcagcatgccgcggtgaatacgttcccgggt

SEQ ID NO: 830 - DNA, 1379 bp, Paenibacillus xylanexedens
  ref <308>: DATABASE ACCESSION NUMBER: NCBI ACCESSION: NZ_RPHH01000020.1
  ref <309>: DATABASE ENTRY DATE: 2019-04-01
  ref <313>: RELEVANT RESIDUES IN SEQ ID NO: (1)..(1379)
ttgttttcttcgcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcctttctatggaga

SEQ ID NO: 831 - DNA, 1456 bp, Paenibacillus xylaniclasticus
  ref <308>: DATABASE ACCESSION NUMBER: NCBI ACCESSION: NZ_BIML01000069.1
  ref <309>: DATABASE ENTRY DATE: 2019-04-01
  ref <313>: RELEVANT RESIDUES IN SEQ ID NO: (1)..(1456)
atggagagtttgatcctggctcaggacgaacgctggcggcgtgcctaatacatgcaagtcgagcggacttgatggagtgcttgcactcctgagagttagcggcggacgggtgagtaacacgtaggcaacctgcccgtaagactgggataacattcggaaacgaatgctaataccagatacgcgacttcctcgcatgggggagtcgggaaagatggagcaatctatcacttacggatgggcctgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaagaaggctttcgggtcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggctttgtaagtctgtcgtttaagttcggggctcaaccccgtatcgcgatggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacgctcgcaagagtgaaactcaaaggaattgacggggacccgcacaagcagtggagtatgtggtttaattcgaagcaacgcgaagaaccttaccaggtcttgacatccctctgaccgctctagagatagggcttcccttcggggcagaggagacaggtggtgcatggttgtcgtcagctcgtgtcgtgagatgttgggttaagtcccgcaacgagcgcaacccttgattttagttgccagcatttcggatgggcactctagaatgactgccggtgacaaaccggaggaaggcggggatgacgtcaaatcatcatgccccttatgacctgggctacacacgtactacaatggccggtacaacgggcagcgaaggagcgatctggagcgaatcctataaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaaaccggtggggtaacc

SEQ ID NO: 832 - DNA, 1564 bp, Paenibacillus yonginensis
  ref <308>: DATABASE ACCESSION NUMBER: NCBI ACCESSION: NZ_CP014167.1
  ref <309>: DATABASE ENTRY DATE: 2019-04-01
  ref <313>: RELEVANT RESIDUES IN SEQ ID NO: (1)..(1564)
tttattggagagtttgatcctggctcaggacgaacgctggcggcgtgcctaatacatgcaagtcgagcggagtggatcgggagcttgctcctgatccacttagcggcggacgggtgagtaacacgtaggcaacctgcctgcaagactgggataactaccggaaacggtagctaataccggatacgcaagagagtcgcatgactttcttgggaaagacggagcaatctgtcacttgtggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcgggtagagtaactgctatccgagtgacggtacctgagaagaaagccccggctaactacgtgccagcagccgcggtaatacgtagggggcaagcgttgtccggaattattgggcgtaaagcgcgcgcaggcggtcatttaagtctggtgtataatcccggggctcaactccgggtcgcactggaaactgggtgacttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggtctagagataggcctttccttcgggacaggggagacaggtggtgcatggttgtcgtcagctcgtgtcgtgagatgttgggttaagtcccgcaacgagcgcaacccttgactttagttgccagcaggtaaagctgggcactctagagtgactgccggtgacaaaccggaggaaggtggggatgacgtcaaatcatcatgccccttatgacctgggctacacacgtactacaatggccggtacaacgggaagcgaaggagcgatctggagcgaatctttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagacgattggggtgaagtcgtaacaaggtagccgtatcggaaggtgcggctggatcacctcctttctatggag

SEQ ID NO: 833 - DNA, 1478 bp, Paraliobacillus quinghaiensis
  ref <308>: DATABASE ACCESSION NUMBER: NCBI ACCESSION: NZ_QJSH01000060.1
  ref <309>: DATABASE ENTRY DATE: 2019-04-01
  ref <313>: RELEVANT RESIDUES IN SEQ ID NO: (1)..(1478)
tttatggagagtttgatcttggctcaggacgaacgctggcggcgtgcctaatacatgcaagtcgagcgcgggaagcaagatgaccccttcggggtgattcttgtggaacgagcggcggacgggtgagtaacacgtgggcaacctgcctgtaagactgggataactcgcggaaacgtgagctaataccggataacacttttctttacctaaggagaagttgaaaggcggcttttcggagctgtcacttacagatgggcccgcggcgcattagctagttggtagggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacaagtaccgttcaaatagggcggtaccttgacggtacctaacgaggaagccccggctaactacgtgccagcagccgcggtaatacgtagggggcaagcgttgtccggaattattgggcgtaaagcgcgcgcaggcggttttttaagtctgatgtgaaatcttgtggctcaaccacaagcggtcattggaaactggagaacttgagtacagaagaggagagtggaattccacgtgtagcggtgaaatgcgtagatatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatccgctgacaatcctagagataggactttcccttcggggacagcgtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgtaggctgcaactcgcctacatgaagccggaatcgctagtaatcgtggatcagcatgccacggtgaatacgttcccgggtcttgtacacaccgcccgtcacaccacgagagttggcaacacccgaagtcggtgaggtaacctttt

SEQ ID NO: 834 - DNA, 363 bp, Paraliobacillus sediminis
  ref <308>: DATABASE ACCESSION NUMBER: NCBI ACCESSION: NZ_QJSI01000001.1
  ref <309>: DATABASE ENTRY DATE: 2019-04-01
  ref <313>: RELEVANT RESIDUES IN SEQ ID NO: (1)..(363)
tttatggagagtttgatcttggctcaggacgaacgctggcggcgtgcctaatacatgcaagtcgagcgcgtgaagcaagtgaatcccttcggggtgaaacttgtggaccgagcggcggacgggtgagtaacacgtgggcaacctgcctgtaagactgggataactccgggaaaccggggctaataccggataacacttttcttcacctgaaggaaagttgaaaggcggctctttgagctgtcacttgcagatgggcccgcggcgcattagctagttggtagggtaatggcctaccaaggcaacgatgcgtagccgacctgagagggtgatcggccacactgggactgagacacggcccagact

SEQ ID NO: 835 - DNA, 1572 bp, Paraliobacillus sp. PM-2
  ref <308>: DATABASE ACCESSION NUMBER: NCBI ACCESSION: NZ_CTEI01000001.1
  ref <309>: DATABASE ENTRY DATE: 2019-04-01
  ref <313>: RELEVANT RESIDUES IN SEQ ID NO: (1)..(1572)
tttatggagagtttgatcttggctcaggacgaacgctggcggcgtgcctaatacatgcaagtcgagcgcaggaagcaagcaatcacccttcggggtgtgcgcttgtggaatgagcggcggacgggtgagtaacacgtgggcaacctacctgtaagactgggataactccgggaaaccggggctaataccggataaaacattggtttgcataaaccaatgatgaaaggcggcttttagctgtcacttacagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaacacgtaccgttcaaatagggcggtaccttgacggtacctaacgaggaagccccggctaactacgtgccagcagccgcggtaatacgtagggggcaagcgttgtccggaattattgggcgtaaagcgcgcgcaggcggttttttaagtctgatgtgaaatcttgtggctcaaccacaagcggtcattggaaactggagaacttgagtgcagaagaggagagtggaattccacgtgtagcggtgaaatgcgtagatatgtggaggaacaccagtggcgaaggcgactctctggtctgtaactgacgctgaggcgcgaaagcgtgggtagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatccgctgcaaaccctagagatagggcgttcccttcggggacagcgtgacaggtggtgcatggttgtcgtcagctcgtgtcgtgagatgttgggttaagtcccgcaacgagcgcaacccttaatcttagttgccagcattaagttgggcactctaaggtgactgccggtgacaaaccggaggaaggtggggatgacgtcaaatcatcatgccccttatgacctgggctacacacgtgctacaatggatggtacaaagggcagcgaagcggtgacgcattagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttctaa

SEQ ID NO: 836 - DNA, 1591 bp, Paraliobacillus sp. X-1125
  ref <308>: DATABASE ACCESSION NUMBER: NCBI ACCESSION: NZ_CP029797.1
  ref <309>: DATABASE ENTRY DATE: 2019-04-01
  ref <313>: RELEVANT RESIDUES IN SEQ ID NO: (1)..(1591)
tttatggagagtttgatcttggctcaggacgaacgctggcggcgtgcctaatacatgcaagtcgagcgcatgaaataagtgaatcccttcggggtgaaacttatggattgagcggcggacgggtgagtaacacgtgggcaacctgcctgtaagactgggataactccgggaaaccggggctaataccggataacacttttctttacctaaagggaagttgaaaggcggctagggtgaaagtttactttcacccctggctgtcacttacagatgggcccgcggcgcattagctagttggtagggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacaagtaccgttctaacaggacggtaccttgacggtacctaacgaggaagccccggctaactacgtgccagcagccgcggtaatacgtagggggcaagcgttgtccggaattattgggcgtaaagcgcgcgcaggcggttctttaagtctgatgtgaaatcttgtggctcaaccacaagcggtcattggaaactggggaacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgcagctaacgcattaagcactccgcctggggagtacggccgcaaggctgaaactcaaaagaattgacggggacccgcacaagcggtggagcatgtggtttaattcgaagcaacgcgaagaaccttaccaggtcttgacatccgctgccaaccctagagatagggcgttcccttcggggacagcgtgacaggtggtgcatggttgtcgtcagctcgtgtcgtgagatgttgggttaagtcccgcaacgagcgcaacccttgattttagttgccagcatttagttgggcactctaaagtgactgccggtgataaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttagcaacacccgaagtcggtgaggtaacctttacaggaaccagccgccgaaggtggggccaatgattggggtgaagtcgtaacaaggtagccgtatcggaaggtgcggctggatcacctcctttcta

SEQ ID NO: 837 - DNA, 1310 bp, Paraliobacillus sp. X-1174
  ref <308>: DATABASE ACCESSION NUMBER: NCBI ACCESSION: NZ_QJSJ01000041.1
  ref <309>: DATABASE ENTRY DATE: 2019-04-01
  ref <313>: RELEVANT RESIDUES IN SEQ ID NO: (1)..(1310)
gcgcattagctagttggtagggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacaagtaccgttctaacaggacggtaccttgacggtacctaacgaggaagccccggctaactacgtgccagcagccgcggtaatacgtagggggcaagcgttgtccggaattattgggcgtaaagcgcgcgcaggcggttctttaagtctgatgtgaaatcttgtggctcaaccacaagcggtcattggaaactggggaacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgcagctaacgcattaagcactccgcctggggagtacggccgcaaggctgaaactcaaaagaattgacggggacccgcacaagcggtggagcatgtggtttaattcgaagcaacgcgaagaaccttaccaggtcttgacatccgctgataaccctagagatagggcgttcccttcggggacagcgtgacaggtggtgcatggttgtcgtcagctcgtgtcgtgagatgttgggttaagtcccgcaacgagcgcaacccttgattttagttgccagcatttagttgggcactctaaagtgactgccggtgataaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttagcaacacccgaagtcggtgaggtaacctttacaggaaccagccgccgaaggtggggccaatgattggggtgaagtcgtaacaaggtagccgtatcggaaggtgcggctggatcacctcctttcta

SEQ ID NO: 838 - DNA, 1335 bp, Paraliobacillus sp. X-1268
  ref <308>: DATABASE ACCESSION NUMBER: NCBI ACCESSION: NZ_QJSK01000043.1
  ref <309>: DATABASE ENTRY DATE: 2019-04-01
  ref <313>: RELEVANT RESIDUES IN SEQ ID NO: (1)..(1335)
gctgtcacttacagatgggcccgcggcgcattagctagttggtagggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacaagtaccgttctaacaggacggtaccttgacggtacctaacgaggaagccccggctaactacgtgccagcagccgcggtaatacgtagggggcaagcgttgtccggaattattgggcgtaaagcgcgcgcaggcggttctttaagtctgatgtgaaatcttgtggctcaaccacaagcggtcattggaaactggggaacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgcagctaacgcattaagcactccgcctggggagtacggccgcaaggctgaaactcaaaagaattgacggggacccgcacaagcggtggagcatgtggtttaattcgaagcaacgcgaagaaccttaccaggtcttgacatccgctgataaccctagagatagggcgttcccttcggggacagcgtgacaggtggtgcatggttgtcgtcagctcgtgtcgtgagatgttgggttaagtcccgcaacgagcgcaacccttgattttagttgccagcatttagttgggcactctaaagtgactgccggtgataaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttagcaacacccgaagtcggtgaggtaacctttacaggaaccagccgccgaaggtggggccaatgattggggtgaagtcgtaacaaggtagccgtatcggaaggtgcggctggatcacctcctttcta

SEQ ID NO: 839 - DNA, 247 bp, Piscibacillus halophilus
  ref <308>: DATABASE ACCESSION NUMBER: NCBI ACCESSION: NZ_FOES01000049.1
  ref <309>: DATABASE ENTRY DATE: 2019-04-01
  ref <313>: RELEVANT RESIDUES IN SEQ ID NO: (1)..(247)
tttatggagagtttgatcctggctcaggacgaacgctggcggcgtgcctaatacatgcaagtcgagcgcgggaagcaaactgaatccttcgggaggacgtttgtggaacgagcggcggacgggtgagtaacacgtgggcaacctgcctgtaagactgggataactccgggaaaccggggctaataccggataactcatcggatcgcatgatccgaggttgaaagatggcttcttgctatcacttaca

SEQ ID NO: 840 - DNA, 1554 bp, Planifilum fimeticola
  ref <308>: DATABASE ACCESSION NUMBER: NCBI ACCESSION: NZ_PVNE01000057.1
  ref <309>: DATABASE ENTRY DATE: 2019-04-01
  ref <313>: RELEVANT RESIDUES IN SEQ ID NO: (1)..(1554)
ttaggagagtttgatcctggctcaggacgaacgctggcggcgtgcctaatacatgcaagtcgggcggggttttgaggggcttgcccttcaagacccagcggcgaacgggtgagtaacacgtgggcaacctgcccgcaagaccgggataacttcgggaaaccggagctaataccggataggaccccggatcgcatgatccggggtggaaaggcggcctcggctgccacttgcggatgggcccgcggcgcattagctagttggtgaggtaacggctcaccaaggtgacgatgcgtagccgacctgagagggtgaccggccacactgggactgagacacggcccagactcctacgggaggcagcagtagggaattttccgcaatgggcgcaagcctgacggagcaacgccgcgtgagcgaggacggccttcgggttgtaaagctctgttcttcgggaagaatggcgggagggcgaacaactctcccgcatgacggtaccgaaggagaaagccccggctaactacgtgccagcagccgcggtaatacgtagggggcgagcgttgtccggaattattgggcgtaaagcgcgcgtaggcggccggttaagtcctgtgtgaaagaccacggctcaaccgtgggggtgcatgggaaactggccggcttgagtgcaggagaggggagcggaattcccggtgtagcggtggaatgcgtagagatcgggaggaacaccagtggcgaaggcggctctctggcctgtaactgacgctgaggcgcgaaagcgtggggagcgaacaggattagataccctggtagtccacgccgtaaacgatgagtgctaggtgttgggggcatcaggccctctgtgccgaaggaaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccggtgcagagatgcgccttcccttcggggcagcggtgacaggtggtgcatggttgtcgtcagctcgtgtcgtgagatgttgggttcagtcccgcaacgagcgcaacccttgcccttagttgccagcgggtaaagccgggcactctaaggggacagccggtgaaagccggaggaaggtggggatgacgtcaaatcatcatgccccttatgtcctgggctacacacgtgctacaatggccggtacaaagggcagcgaacccgcgagggggagccaatcccaaaaagccggtctcagttcggatcgcaggctgcaactcgcctgcgtgaaggcggaatcgctagtaatcgcggatcagcatgccgcggtgaatacgttcccgggccttgtacacaccgcccgtcacaccacgagagtctgcaacacccgaagtcggtgagccaacccgcaagggaggcagccgccgaaggtggggcagatgattggggtgaagtcgtaacaaggtatccctaccggaaggtggggatggatcacctcctttcta

SEQ ID NO: 841 - DNA, 263 bp, Planifilum fulgidum
  ref <308>: DATABASE ACCESSION NUMBER: NCBI ACCESSION: NZ_FOOK01000022.1
  ref <309>: DATABASE ENTRY DATE: 2019-04-01
  ref <313>: RELEVANT RESIDUES IN SEQ ID NO: (1)..(263)
ggagagtttgatcctggctcaggacgaacgctggcggcgtgcctaatacatgcaagtcgtgcggggtcttgaagggcttgccctttaagacccagcggcgaacgggtgagtaacacgtgggtaacctgcccgcaagaccgggataactccgggaaaccggggctaataccggataagactccggatcgcatgatccggggtggaaaggcggcgtcaagctgccacttgcggatgggcccgcggcgcattagctggttggtgag

SEQ ID NO: 842 - DNA, 355 bp, Propionispora vibrioides
  ref <308>: DATABASE ACCESSION NUMBER: NCBI ACCESSION: NZ_FODY01000035.1
  ref <309>: DATABASE ENTRY DATE: 2019-04-01
  ref <313>: RELEVANT RESIDUES IN SEQ ID NO: (1)..(355)
ttttatggagagtttgatcctggctcaggacgaacgctggcggcgtgcctaacacatgcaagtcgaacggtctggtgtttaacaccaaacgctacatgctaaccggggaatcacaattgagccgcgtcttatgaacgagcgaagcgagttcatcacgcatcttcaaagtgactaaccggaaagtaagagcgattggtgttgaacgccaggtagtggcgaacgggtgagtaacgcgtaaacaacctgcctcatagatggggacaacaccgcgaaagtggtgctaataccgaatgttttgatcttgccgcatggtgagattaataaaggtggcctctaaattatgctaccgttatga

SEQ ID NO: 843 - DNA, 1372 bp, Salinibacillus kushneri
  ref <308>: DATABASE ACCESSION NUMBER: NCBI ACCESSION: NZ_FOHJ01000023.1
  ref <309>: DATABASE ENTRY DATE: 2019-04-01
  ref <313>: RELEVANT RESIDUES IN SEQ ID NO: (1)..(1372)
ttctgaccgcatggtcaggagttgaaagacggcttttaagctgtcccttacagatgggcccgcggcgcattagctagttggtgaggtaagagcttaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggtcttcggatcgtaaagctctgttgttagggaagaacaagtacaagaggaactgcttgtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggcttaaccgtggagggtcattggaaactgggaggcttgagtgcaggagaggagagtggaattccacgtgtagcggtgaaatgcgtagatatgtggaggaacaccagtggcgaaggcgactctctggcctgtaactgacgctgaggcgcgaaagcgtggggagcgaacaggattagataccctggtagtccacgccgtaaacgttgagtgctaggtgttagggggtttccgccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgctacctctagagatagagggttcccttcggggacagagtgacaggtggtgcatggttgtcgtcagctcgtgtcgtgagatgttgggttaagtcccgcaacgagcgcaacccttaaccttagttgccagcatttagttgggcactctagggtgactgccggtgacaaaccggaggaaggtggggatgacgtcaaatcatcatgccccttatgacctgggctacacacgtgctacaatggatggtacaaagggcagcgaagccgcaaggtgaagctaatcccataaaaccattctcagttcggattgcaggctgcaactcgcctgtatgaagccggaatcgctagtaatcgcggatcagcatgccgcggtgaatacgttcccgggccttgtacacaccgcccgtcacaccacgagagttggcaacacccgaagtcggtggggtaaccttatggaactagccgcctaaggtggggccaatgattggggtgaagtcgtaacaaggtagccgtatcggaaggtgcggctggatcacctcctttctaa

SEQ ID NO: 844 - DNA, 1480 bp, Salsuginibacillus halophilus
  ref <308>: DATABASE ACCESSION NUMBER: NCBI ACCESSION: NZ_PYAV01000027.1
  ref <309>: DATABASE ENTRY DATE: 2019-04-01
  ref <313>: RELEVANT RESIDUES IN SEQ ID NO: (1)..(1480)
gggatgacgctggtggatcgagcggcggacgggtgagtaacacgtgggcaacctgccctgcagatcgggataaccccgggaaaccggggctaataccgaatgaccggaagaatcgcctgattctttcgtaaaagctgggatttatcctagcactgcaggatgggcccgcggcgcattagttagttggtgaggtaatggctcaccaaggcgacgatgcgtagccgacctgagagggtgatcggccacactgggactgagacacggcccagactcctacgggaggcagcagtagggaatcatccgcaatggacgaaagtctgacggtgcaacaccgcgtgagtgacgaaggcctcagggtcgtaaagctctgttatcaaggaagaaaacgtactgtgcgaatagagcagtaccttgccggtacttgatcagaaagccccggctaactacgtgccagcagccgcggtaacacgtagggggcgagcgttgtccggaattattgggcgtaaagggcacgcaggcggccttttaagtctgatgtgaaagcccgtggctcaaccacggaatggcattggaaactgaaaggcttgagtgcagaagaggagagcggaattccacgtgtagcggtgaaatgcgtagatatgtggaggaacaccagtggcgaaggcggctctctggtctgtaactgacgctgaggtgcgaaagcgtggggagcgaacaggattagataccctggtagtccacgccgtaaacgttgagtgctaggtgttaggggtttcgatacccttagtgccgaagtaaacacattaagcactccgcctggggagtacgaccgcaaggttgaaactcaaaggaattgacgggggcctgcacaagcggtggagcatgtggtttaattcgatgcaacgcgaagaaccttaccaggtcttgacatcttttgcccgctctggagacagagttttcccttcggggacaaaatgacaggtggtgcatggttgtcgtcagctcgtgtcgtgagatgttgggttaagtcccgcaacgagcgcaacccttgaccttagttgccagcattcagttgggcactctagggtgactgccggtgacaaaccggaggaaggtggggatgacgtcaaatcatcatgccccttatgacctgggctacacacgtgctacaatggatggtacaaagggttgcgaggccgcgaggccgagccaatcccaaaaagccattctcagttcggattgttctctgcaactcgagaacatgaagccggaatcgctagtaatcgcggatcagaatgccgcggtgaatacgttcccaggccttgtacacaccgcccgtcacaccacgagagcttgcaacgcccgaagtcggtcaggtaacctttttaggagccagccgccgaaggtggggcaggtgattggggtgaagtcgtaacaaggtatccctaccggaaggtggggatggatcacctcctttcta

SEQ ID NO: 845 - DNA, 1304 bp, Sporolactobacillus nakayamae
  ref <308>: DATABASE ACCESSION NUMBER: NCBI ACCESSION: NZ_FOOY01000002.1
  ref <309>: DATABASE ENTRY DATE: 2019-04-01
  ref <313>: RELEVANT RESIDUES IN SEQ ID NO: (1)..(1304)
tttttggagagtttgatcctggctcaggacgaacgctggcggcgtgcctaatacatgcaagtcgagcgcattgaagggagcttgctcccggatgtgagcggcggatgggtgagtaacacgtgggtaacctgcctgtcagattgggataactgtgggaaaccgcagctaataccgaatgatcccctgcaccacatggtgcagggttgaaagatggtttcggccatcactgacagatgggcccgcggtgcattagttagttggcggggtaacggcccaccaagacagcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgccggagaagaatgagtatgagaggaaatgcttgtactgtgacggtatccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaaatggtcattggaaactgggaagcttgagtgcagaagaggagagtagaattccacgtgtagcggtgaaatgcgtagatatgtggaggaataccagtggcgaaggcggctctctggtctgtaactgacgctgaggcgcgaaagcgtggggagcaaacaggattagataccctggtagtccacgccgtaaacgatgaatgctaggtgttagggggtccaacccttagtgctgaagttaacacattaagcattccgcctggggagtacgaccgcaaggttgaaactcaaaggaattgacgggggcccgcacaagcagtggagcatgtggtttaattcgaagcaacgcgaagaaccttaccaggtcttgacatcctctgacaagcctagagataggccgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgatctgggctacacacgtgctacaatgggtggtacaaagggcagcgaaaccgcgaggtcaagcgaatcccataaagccaccccc

SEQ ID NO: 846 - DNA, 1553 bp, Sporolactobacillus pectinivorans
  ref <308>: DATABASE ACCESSION NUMBER: NCBI ACCESSION: NZ_NXGA01000001.1
  ref <309>: DATABASE ENTRY DATE: 2019-04-01
  ref <313>: RELEVANT RESIDUES IN SEQ ID NO: (1)..(1553)
tttttggagagtttgatcctggctcaggacgaacgctggcggcgtgcctaatacatgcaagtcgagcgcacggaagggggcttgcccccggaagtgagcggcggatgggtgagtaacacgtgggcaacctgcctgtaagacggggataactccgggaaacgggagctaataccgggtaacacgctgcaccgcatggtgcagggttgaaagatggtttcggccatcgcttacagatgggcccgcggtgcattagttagttggcggggcaacggcccaccaagaccgcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgccggagaagaatgagtgagagaggaaatgctcttgcagtgacggtatccggccagaaagccacggctaactacgtgccagcagccgcggtaatacgtaggtggcaagcgttgtccggaattattgggcgtaaagcgcgcgcaggcggcttcctaagtctgatgtgaaatcttgcggctcaaccgcaagcggccattggaaactggggagcttgagtacagaagaggagagtagaattccacgtgtagcggtgaaatgcgtagagatgtggaggaataccggtggcgaaggcggctctctggtctgttactgacgctgaggtgcgaaagcgtggggagcaaacaggattagataccctggtagtccacgctgtaaacgatgaatgctaggtgttaggggggtccaaccccttagtgctgaagttaacacattaagcattccgcctgggaagtacgaccgcaaggttgaaactcaaaggaattgacgggggcccgcacaagcagtggagcatgtggtttaattcgaagcaacgcgaagaaccttaccaggtcttgacatccttcgaccgcctgagagatcaggctttccccttcgggggacggagtgacaggtggtgcatggttgtcgtcagctcgtgtcgtgagatgttgggttaagtcccgcaacgagcgcaacccttgaccttagttgccagcattgagttgggcactctagggtgactgccggtgacaaaccggaggaaggtggggatgacgtcaaatcatcatgccccttatgatctgggctacacacgtgctacaatgggcggtacaaagggctgcgagaccgcgaggttgagccaatcccataaagccgcccccagttcggattgcaggctgcaacccgcctgcatgaagccggaattgctagtaatcgcggatcagcatgccgcggtgaatccgttcccgggccttgtacacaccgcccgtcacaccacgagagtggataacacccgaagtcggtgcgggaacctttatggacccagccgccgaaggtgggacccatgattggggtgaagtcgtaacaaggtagccgtatcggaaggtgcggctggatcacctcctttct

SEQ ID NO: 847 - DNA, 1559 bp, Sporolactobacillus sp. THM19-2
  ref <308>: DATABASE ACCESSION NUMBER: NCBI ACCESSION: NZ_SEMC01000039.1
  ref <309>: DATABASE ENTRY DATE: 2019-04-01
  ref <313>: RELEVANT RESIDUES IN SEQ ID NO: (1)..(1559)
tttttggagagtttgatcctggctcaggacgaacgctggcggcgtgcctaatacatgcaagtcgtgcgcacagaggggagcttgctccctgaggtgagcggcggatgggtgagtaacacgtgggcaacctgccggtcagactgggataactgtgggaaaccgcagctaataccggatgatcctccgcaccgcatggtgcggagctgaaagatggtttcggccatcactgactgatgggcccgcggtgcattagcttgttggcggggtaacggcccaccaaggctgcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgccggagaagaacggatgcgggaggaaatgtccgcgtcgtgacggtatccggccagaaagccacggctaactacgtgccagcagccgcggtaatacgtaggtggcaagcgttgtccggaattattgggcgtaaagcgcgcgcaggcggcttcttaagtctgatgtgaaattctgcagctcaactgcaggcgggcattggaaactggggagcttgagtacagaagaggagagtagaattccacgtgtagcggtgaaatgcgtagagatgtggaggaataccagtggcgaaggcggctctctggtctgttactgacgctgaggtgcgaaagcgtggggagcgaacaggattagataccctggtagtccacgccgtaaacgatgaatgccaggtgttaggggggtccaaccccttagtgctgaagttaacacattaagcattccgcctggggagtacggccgcaaggctgaaactcaaaggaattgacgggggcccgcacaagcagtggagcatgtggtttaattcgaagcaacgcgaagaaccttaccaggtcttgacatccttcgaccgcccgagagatcgggttttccccttcgggggacgaagtgacaggtggtgcatggttgtcgtcagctcgtgtcgtgagatgttgggttaagtcccgcaacgagcgcaacccttgaccctggttgccagcattcagttgggcactcgagggtgactgccggtgacaaaccggaggaaggtggggatgacgtcaaatcatcatgccccttatgatctgggctacacacgtgctacaatgggcggtacaaagggcagcgaagccgcgaggctgagccaatcccataaagccgcccccagttcggattgcaggctgcaacccgcctgcatgaagccggaattgctagtaatcgcggatcagcatgccgcggtgaatccgttcccgggccttgtacacaccgcccgtcacaccacgagagtttgtaacacccgaagtcggtgcgggaacctttatgggcccagccgccgaaggtgggacaaatgattggggtgaagtcgtaacaaggtagccgtatcggaaggtgcggctggatcacctcctttctaaggaa

SEQ ID NO: 848 - DNA, 1568 bp, Sporolactobacillus sp. THM7-4
  ref <308>: DATABASE ACCESSION NUMBER: NCBI ACCESSION: NZ_SEMD01000029.1
  ref <309>: DATABASE ENTRY DATE: 2019-04-01
  ref <313>: RELEVANT RESIDUES IN SEQ ID NO: (1)..(1568)
tttttggagagtttgatcctggctcaggacgaacgctggcggcgtgcctaatacatgcaagtcgagcgcaggaagcgggcggatcccttcggggtgacgcccgccgaatgagcggcggatgggtgagtaacacgtgggcaacctgcctgtaagacggggataacctcgggaaaccggggctaataccgggtaatcttccgcaccacatggtgcggaagtgaaagatggtttcggccatcgcttacagatgggcccgcggtgcattagttagttggcggggtaacggcccaccaagacagcgatgcatagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaagctctgttgccggagaagaacggatgccagaggaaatgctggtgtcgtgacggtatccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaagcggtcattggaaactggggagcttgagtgcagaagaggagagtagaattccacgtgtagcggtgaaatgcgtagagatgtggaggaataccggtggcgaaggcggctctctggtctgttactgacgctgaggtgcgaaagcgtggggagcaaacaggattagataccctggtagtccacgccgtaaacgatgaatgccaggtgttaggggggtccaaccccttagtgctgaagttaacacattaagcattccgcctggggagtacgaccgcaaggttgaaactcaaaggaattgacgggggcccgcacaagcagtggagcatgtggtttaattcgaagcaacgcgaagaaccttaccaggtcttgacatcctctgaccgcctgagagatcaggttttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgatctgggctacacacgtgctacaatgggcggtacaaagggcagcgaagccgcgaggccgagccaatcccataaagccgcccccagttcggattgcaggctgcaacccgcctgcatgaagccggaattgctagtaatcgcggatcagcatgccgcggtgaatccgttcccgggccttgtacacaccgcccgtcacaccacgagagtttgtaacacccgaagtcggtgcgataacctttatggaatcagccgccgaaggtgggacaaatgattggggtgaagtcgtaacaaggtagccgtatcggaaggtgcggctggatcacctcctttcta

SEQ ID NO: 849 - DNA, 1472 bp, Sporolactobacillus sp. THM7-7
  ref <308>: DATABASE ACCESSION NUMBER: NCBI ACCESSION: NZ_SEMB01000078.1
  ref <309>: DATABASE ENTRY DATE: 2019-04-01
  ref <313>: RELEVANT RESIDUES IN SEQ ID NO: (1)..(1472)
gaagggcgcggaccgagcggcggacgggtgagtaacacgtgggcaacctgcctgtcagacggggataactccgggaaaccggagctaataccggataggctttcgcaccgcatggtgcggaagggaaaggtggtttcggccatcgctgacagatgggcccgcggtgcattagctggttggcggggtagcggcccaccaaggcgacgatgcatagccgacctgagagggtgatcggccacattgggactgagacacggcccaaactcctacgggaggcagcagtagggaatcttccgcaatggacgcaagtctgacggagcaacgccgcgtgagcgaagaaggttttcggatcgtaaagctctgttgccggagaagaacggacgccggaggaaatgccggagtcgtgacggtaaccggccagaaagccacggctaactacgtgccagcagccgcggtaatacgtaggtggcaagcgttgtccggaattattgggcgtaaagcgcgcgcaggcggctctttaagtctgatgtgaaaggttgcggcttaaccgcaaaaggtcattggaaactggggagcttgagtgcagaagaggagagtagaattccacgtgtagcggtgaaatgcgtagagatgtggaggaataccggtggcgaaagcggctctctggtctgtcactgacgctgaggtgcgaaagcgtggggagcgaacaggattagataccctggtagtccacgccgtaaacgatgaatgctaggtgttaggggggtccaaccccttagtgctgaagtcaacacattaagcattccgcctggggagtacgaccgcaaggttgaaactcaaaggaattgacgggggcccgcacaagcagtggagcatgtggtttaattcgaagcaacgcgaagaaccttaccaggtcttgacatcctctgacacctctagagatagagggttccccttcgggggacagagtgacaggtggtgcatggttgtcgtcagctcgtgtcgtgagatgttgggttaagtcccgcaacgagcgcaacccttgacgttagttgccagcattgagttgggcactctaaggtgactgccggtgacaaaccggaggaaggtggggatgacgtcaaatcatcatgccccttatgatctgggcgacacacgtgctacaatgggcggtacagagggcagcgaagccgcgaggccgagcgaatcccgaaaagccgcccccagttcggattgcaggctgcaacccgcctgcatgaagccggaattgctagtaatcgcggatcagcatgccgcggtgaatccgttcccgggccttgtacacaccgcccgtcacaccacgagagtttgtaacacccgaagtcggtgcgggaacctttcggacccagccgccgaaggtgggacaaatgattggggtgaagtcgtaacaaggtagccgtatcggaaggtgcggctggatcacctcctttcta

SEQ ID NO: 850 - DNA, 1554 bp, Sporolactobacillus terrae
  ref <308>: DATABASE ACCESSION NUMBER: NCBI ACCESSION: NZ_CP025688.1
  ref <309>: DATABASE ENTRY DATE: 2019-04-01
  ref <313>: RELEVANT RESIDUES IN SEQ ID NO: (1)..(1554)
tttttggagagtttgatcctggctcaggacgaacgctggcggcgtgcctaatacatgcaagtcgagcgcacagaagggagcttgctcctggacgtgagcggcggatgggtgagtaacacgtgggcaacctgcctgtaagacggggataacttcgggaaaccggagctaataccggataatccctcgcaccgcatggtgcgaggctgaaagatggtttcggccatcacttacagatgggcccgcggtgcattagttagttggcggggtaacggcccaccaagaccgcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgccggagaagaacgagtgccagaggaaatgctggtgctgtgacggtatccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaaaaggtcattggaaactggggagcttgagtgcagaagaggagagtagaattccacgtgtagcggtgaaatgcgtagagatgtggaggaataccagtggcgaaggcggctctctggtctgttactgacgctgaggtgcgaaagcatggggagcaaacaggattagataccctggtagtccatgccgtaaacgatgaatgctaggtgttaggggggtccaaccccttagtgctgaagttaacacattaagcattccgcctggggagtacgaccgcaaggttgaaactcaaaggaattgacgggggcccgcacaagcagtggagcatgtggtttaattcgaagcaacgcgaagaaccttaccaggtcttgacatcctctgacaagtctagagataggccgttccccttcgggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgatctgggctacacacgtgctacaatgggcggtacaaagggcagcgaaaccgcaaggtcaagcgaatcccataaagccgcccccagttcggattgcaggctgcaactcgcctgcatgaagccggaattgctagtaatcgcggatcagcatgccgcggtgaatccgttcccgggccttgtacacaccgcccgtcacaccacgagagtttgtaacacccgaagtcggtgtgggaacctttatggacccagccgccgaaggtgggacaaatgattggggtgaagtcgtaacaaggtagccgtatcggaaggtgcggctggatcacctcctttcta

SEQ ID NO: 851 - DNA, 528 bp, Sporomusa acidovorans
  ref <308>: DATABASE ACCESSION NUMBER: NCBI ACCESSION: NZ_FNAM01000094.1
  ref <309>: DATABASE ENTRY DATE: 2019-04-01
  ref <313>: RELEVANT RESIDUES IN SEQ ID NO: (1)..(528)
ttttatggagagtttgatcctggctcaggacgaacgctggcggcgtgcctaacacatgcaagtcgaacggaatttcgcgggttcgaggttcgagaattcgaggatcgaagtatgatgaagcaattgatagatcaattgctaacattaaaatcgaacttcgagcaatcgaacctcgaactagcgaattcagtggcgaacgggtgagtaacgcgtagacaacctgcctctaagctggggacaacaccgcgaaagtggtgctaataccggatgtggtatcttggtcgcatgactgagataagaaagatggcctctttacaatgctatcgattagagatgggtctgcgtctgattagctggttggcggggtaacggcccaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggttttc

SEQ ID NO: 852 - DNA, 873 bp, Sporomusa silvacetica
  ref <308>: DATABASE ACCESSION NUMBER: NCBI ACCESSION: NZ_LSLK01000005.1
  ref <309>: DATABASE ENTRY DATE: 2019-04-01
  ref <313>: RELEVANT RESIDUES IN SEQ ID NO: (1)..(873)
ggctcaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggtcttcggattgtaaagctctgtcgtttgggacgaacgtggaatgtgtgaataatgcattctaatgacggtaccaaaggaggaagccacggctaactacgtgccagcagccgcggtaatacgtaggtggcaagcgttgtccggaattattgggcgtaaagggcgtgtaggtggataattaagtcgtgtgtctaagtgcgaggctcaacctcgtataggcgcaggaaactggttatcttgagtgcaggagaggaaagtggaattcccagtgtagcggtgaaatgcgtagatattgggaggaacaccagtggcgaaggcgactttctggactgtgtctgacactgaggcgcgaaagccaggggagcgaacgggattagataccccggtagtcctggccgtaaacgatgggtactaggtgtagagggtatcgaccccttctgtgccgcaagctaacgcaataagtaccccgcctggggagtacggccgcaaggttgaaactcaaaggaattgacgggggcccgcacaagcggtggagtatgtggtttaattcgacgcaacgcgaagaaccttaccaggacttgacattgagtgaaaaactaagagattagttcctatccttcgggatacacgaaaacaggtggtgcatggctgtcgtcagctcgtgtcgtgagatgttgggttaagtcccgcaacgagcgcaacccttatcctttgttgccagc

SEQ ID NO: 853 - DNA, 745 bp, Sporomusa sphaeroides
  ref <308>: DATABASE ACCESSION NUMBER: NCBI ACCESSION: NZ_FCOW01000089.1
  ref <309>: DATABASE ENTRY DATE: 2019-04-01
  ref <313>: RELEVANT RESIDUES IN SEQ ID NO: (1)..(745)
ggctcaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggtcttcggattgtaaagctctgtcgtttgggacgaacgtggattgtgtgaataatgcaatctaatgacggtaccaaaggaggaagccacggctaactacgtgccagcagccgcggtaatacgtaggtggcaagcgttgtccggaattattgggcgtaaagggcgtgtaggtggattcttaagtcgtgtgtctaagtgcggtgctcaacaccgtatgggcgcaggaaactgggaatcttgagtgcaggagaggaaagtggaattcccagtgtagcggtgaaatgcgtagatattgggaggaacaccagtggcgaaggcgactttctggactgtgtctgacactgaggcgcgaaagccaggggagcgaacgggattagataccccggtagtcctggccgtaaacgatgggtactaggtgtagagggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccagggcttgacattgagtgaaag

SEQ ID NO: 854 - DNA, 324 bp, Sporosarcina sp. BI001-red
  ref <308>: DATABASE ACCESSION NUMBER: NCBI ACCESSION: NZ_QQAK01000011.1
  ref <309>: DATABASE ENTRY DATE: 2019-04-01
  ref <313>: RELEVANT RESIDUES IN SEQ ID NO: (1)..(324)
tttatggagagtttgatcctggctcaggacgaacgctggcggcatgcctaatacatgcaagtcgagcgaatcactaggagcttgctcctagtgattagcggcggacgggtgagtaacacgtgggcaacctgccctgcagatggggataactccgggaaaccggggctaataccgaataatcagttccttcgcatgaaggaactctgaaagacggtttcggctgtcactgcaggatgggcccgcggcgcattagctagttggtggggtaatggcctaccaaggcaacgatgcgtagccgacctgagagggtgatcggccacactg

SEQ ID NO: 855 - DNA, 1554 bp, Sporosarcina sp. P1
  ref <308>: DATABASE ACCESSION NUMBER: NCBI ACCESSION: NZ_PDYS01000043.1
  ref <309>: DATABASE ENTRY DATE: 2019-04-01
  ref <313>: RELEVANT RESIDUES IN SEQ ID NO: (1)..(1554)
ttatggagagtttgatcctggctcaggacgaacgctggcggcatgcctaatacatgcaagtcgagcgaactgttggaagcttgcttccttcagttagcggcggacgggtgagtaacacgtgggcaacctgcccttcagatggggataactccgggaaaccggggctaataccgaataatccattttctcgcatgaggaaatgttgaaagacggtttcggctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgtctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccagaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 856 - DNA, 1555 bp, Sporosarcina sp. P10
  ref <308>: DATABASE ACCESSION NUMBER: NCBI ACCESSION: NZ_PDYK01000038.1
  ref <309>: DATABASE ENTRY DATE: 2019-04-01
  ref <313>: RELEVANT RESIDUES IN SEQ ID NO: (1)..(1555)
ttatggagagtttgatcctggctcaggacgaacgctggcggcatgcctaatacatgcaagtcgagcgaactgttggaagcttgcttccttcagttagcggcggacgggtgagtaacacgtgggcaacctgcccttcagatggggataactccgggaaaccggggctaataccgaataatccattctctcgcatgagagaatgttgaaagacggcatctcgctgtcactgaaggatgggcccgcggcgcattagctagttggtggggtaatggctcaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 857 - DNA, 1555 bp, Sporosarcina sp. P12 2017; identical to SEQ ID NO: 856
  ref <308>: DATABASE ACCESSION NUMBER: NCBI ACCESSION: NZ_PDYL01000037.1
  ref <309>: DATABASE ENTRY DATE: 2019-04-01
  ref <313>: RELEVANT RESIDUES IN SEQ ID NO: (1)..(1555)

SEQ ID NO: 858 - DNA, 1340 bp, Sporosarcina sp. P16a
  ref <308>: DATABASE ACCESSION NUMBER: NCBI ACCESSION: NZ_PDYN01000043.1
  ref <309>: DATABASE ENTRY DATE: 2019-04-01
  ref <313>: RELEVANT RESIDUES IN SEQ ID NO: (1)..(1340)
tctcgctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgtctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccagaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 859 - DNA, 1337 bp, Sporosarcina sp. P17b
  ref <308>: DATABASE ACCESSION NUMBER: NCBI ACCESSION: NZ_PDYP01000037.1
  ref <309>: DATABASE ENTRY DATE: 2019-04-01
  ref <313>: RELEVANT RESIDUES IN SEQ ID NO: (1)..(1337)
ggctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcattcagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 860 - DNA, 1554 bp, Sporosarcina sp. P19
  ref <308>: DATABASE ACCESSION NUMBER: NCBI ACCESSION: NZ_PDYR01000034.1
  ref <309>: DATABASE ENTRY DATE: 2019-04-01
  ref <313>: RELEVANT RESIDUES IN SEQ ID NO: (1)..(1554)
ttatggagagtttgatcctggctcaggacgaacgctggcggcatgcctaatacatgcaagtcgagcgaactgttggaagcttgcttccttcagttagcggcggacgggtgagtaacacgtgggcaacctgcccttcagatggggataactccgggaaaccggggctaataccgaataatccattctctcgcatgagagaatgttgaaagacggtttcggctgtcactgaaggatgggcccgcggcgcattagctagttggtggggtaatggctcaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcattcagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 861 - DNA, 1554 bp, Sporosarcina sp. P20a
  ref <308>: DATABASE ACCESSION NUMBER: NCBI ACCESSION: NZ_PDYT01000053.1
  ref <309>: DATABASE ENTRY DATE: 2019-04-01
  ref <313>: RELEVANT RESIDUES IN SEQ ID NO: (1)..(1554)
ttatggagagtttgatcctggctcaggacgaacgctggcggcatgcctaatacatgcaagtcgagcgaactgttggaagcttgcttccttcagttagcggcggacgggtgagtaacacgtgggcaacctgcccttcagatggggataactccgggaaaccggggctaataccgaataatccattctctcgcatgagaggatgttgaaagacggtttcggctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccagaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 862 - DNA, 1336 bp, Sporosarcina sp. P21c
  ref <308>: DATABASE ACCESSION NUMBER: NCBI ACCESSION: NZ_PDYU01000046.1
  ref <309>: DATABASE ENTRY DATE: 2019-04-01
  ref <313>: RELEVANT RESIDUES IN SEQ ID NO: (1)..(1336)
gctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgtctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccagaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 863 - DNA, 1481 bp, Sporosarcina sp. P25
  ref <308>: DATABASE ACCESSION NUMBER: NCBI ACCESSION: NZ_PDYV01000041.1
  ref <309>: DATABASE ENTRY DATE: 2019-04-01
  ref <313>: RELEVANT RESIDUES IN SEQ ID NO: (1)..(1481)
ggaagcttgcttccttcagttagcggcggacgggtgagtaacacgtgggcaacctgcccttcagatggggataactccgggaaaccggggctaataccgaataatccattttctcgcatgaggaaatgttgaaagacggcgtctcgctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgtctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccagaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 864 - DNA, 1341 bp, Sporosarcina sp. P26b
  ref <308>: DATABASE ACCESSION NUMBER: NCBI ACCESSION: NZ_PDYW01000061.1
  ref <309>: DATABASE ENTRY DATE: 2019-04-01
  ref <313>: RELEVANT RESIDUES IN SEQ ID NO: (1)..(1341)
tttcggctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcattcagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 865 - DNA, 1554 bp, Sporosarcina sp. P29
  ref <308>: DATABASE ACCESSION NUMBER: NCBI ACCESSION: NZ_PDYX01000048.1
  ref <309>: DATABASE ENTRY DATE: 2019-04-01
  ref <313>: RELEVANT RESIDUES IN SEQ ID NO: (1)..(1554)
ttatggagagtttgatcctggctcaggacgaacgctggcggcatgcctaatacatgcaagtcgagcgaactgttggaagcttgcttccttcagttagcggcggacgggtgagtaacacgtgggcaacctgcccttcagatggggataactccgggaaaccggggctaataccgaataatccattctctcgcatgagagaatgttgaaagacggtttcggctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 866 - DNA, 1341 bp, Sporosarcina sp. P3
  ref <308>: DATABASE ACCESSION NUMBER: NCBI ACCESSION: NZ_PDZE01000033.1
  ref <309>: DATABASE ENTRY DATE: 2019-04-01
  ref <313>: RELEVANT RESIDUES IN SEQ ID NO: (1)..(1341)
atctcgctgtcactgaaggatgggcccgcggcgcattagctagttggtggggtaatggctcaccaaggcaacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcattcagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 867 - DNA, 1554 bp, Sporosarcina sp. P30; identical to SEQ ID NO: 865
  ref <308>: DATABASE ACCESSION NUMBER: NCBI ACCESSION: NZ_PDYZ01000055.1
  ref <309>: DATABASE ENTRY DATE: 2019-04-01
  ref <313>: RELEVANT RESIDUES IN SEQ ID NO: (1)..(1554)

SEQ ID NO: 868 - DNA, 1554 bp, Sporosarcina sp. P31; identical to SEQ ID NO: 865
  ref <308>: DATABASE ACCESSION NUMBER: NCBI ACCESSION: NZ_PDZA01000053.1
  ref <309>: DATABASE ENTRY DATE: 2019-04-01
  ref <313>: RELEVANT RESIDUES IN SEQ ID NO: (1)..(1554)

SEQ ID NO: 869 - DNA, 1337 bp, Sporosarcina sp. P32b
  ref <308>: DATABASE ACCESSION NUMBER: NCBI ACCESSION: NZ_PDZB01000054.1
  ref <309>: DATABASE ENTRY DATE: 2019-04-01
  ref <313>: RELEVANT RESIDUES IN SEQ ID NO: (1)..(1337)
ggctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 870 - DNA, 1272 bp, Sporosarcina sp. P35
  ref <308>: DATABASE ACCESSION NUMBER: NCBI ACCESSION: NZ_PDZD01000063.1
  ref <309>: DATABASE ENTRY DATE: 2019-04-01
  ref <313>: RELEVANT RESIDUES IN SEQ ID NO: (1)..(1272)
aacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccactgaccggcatggagacatgcctttcccttcggggacagtggtgacaggtggtgcatggttgtcgtcagctcgtgtcgtgagatgttgggttaagtcccgcaacgagcgcaacccttaatcttagttgccatcattcagttgggcactctaaggtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 871 - DNA, 1554 bp, Sporosarcina sp. PTS2304
  ref <308>: DATABASE ACCESSION NUMBER: NCBI ACCESSION: NZ_CP031230.1
  ref <309>: DATABASE ENTRY DATE: 2019-04-01
  ref <313>: RELEVANT RESIDUES IN SEQ ID NO: (1)..(1554)
ttatggagagtttgatcctggctcaggacgaacgctggcggcatgcctaatacatgcaagtcgagcgaaagtgtagaagcttgcttctatactttagcggcggacgggtgagtaacacgtgggcaacctaccttacagatggggataactccgggaaaccggggctaataccgaataatccattttctcgcatgagtgaatgttgaaagacggcttcggctgtcactgttagatgggcccgcggcgcattagctagttggtggggtaacggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacacgtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacggtacagagggttgccaacccgcgagggggagctaatcccagaaaaccgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 872 - DNA, 1565 bp, Tenuibacillus multivorans
  ref <308>: DATABASE ACCESSION NUMBER: NCBI ACCESSION: NZ_FNIG01000018.1
  ref <309>: DATABASE ENTRY DATE: 2019-04-01
  ref <313>: RELEVANT RESIDUES IN SEQ ID NO: (1)..(1565)
tttatggagagtttgatcctggctcaggacgaacgctggcggcgtgcctaatacatgcaagtcgagcgcgggaagcagacagaatccttcgggaggacgtctgtggaacgagcggcggacgggtgagtaacacgtgggcaacctgcctgtaagactgggataactccgggaaaccggggctaataccggataattcatcgaatcgcatgattcgatgttgaaaggtggcatatgctactacttacagatgggcccgcggcgcattagttagttggtggggtaaaagcctaccaaggccacgatgcgtagccgacctgagagggtgatcggccacactgggactgagacacggcccagactcctacgggaggcagcagtagggaatcatccgcaatggacgcaagtctgacggtgcaacgccgcgtgagtgaggaaggtcttcggatcgtaaaactctgttgttagagaagaacaagtaccgttcgaatagggcggtaccttgacggtacctaaccagaaagccacggctaactacgtgccagcagccgcggtaatacgtaggtggcaagcgttgtccggaattattgggcgtaaagggcgcgcaggcggttccttaagtctggtgtgacagcccacggctcaaccgtggagggtcatcggaaactggggaacttgagtacagaagaggagagcggaattccacgtgtagcggtgaaatgcgtagatatgtggaggaacaccagtggcgaaggcggctctctggtctgtgactgacgctgaggcgcgaaagcgtgggtagcgaacaggattagataccctggtagtccacgccgtaaacgatgagtgctaggtgttaggggtttccacccttagtgctgcagttaacgcaataagcactccgcctggggagtacggccgcaaggctgaaactcaaaggaattgacgggggcccgcacaagcggtggagcatgtggtttaattcgaagcaacgcgaagaaccttaccaggtcttgacatcttcggaccaccctagagatagggtcttcccttcggggaccgaatgacaggtggtgcatggttgtcgtcagctcgtgtcgtgagatgttgggttaagtcccgtaacgagcgcaacccttgatcttagttgccagcattgagttgggcactctaaggtgactgccggtgacaaatcggaggaaggtggggatgacgtcaaatcatcatgccccttatgacctgggcaacacacgtgctacaatggatggtacaatgggcagcgaagccgtgaggtgaagcaaatcccaaaaagccattctcagttcggattgtaggctgcaactcgcctgcatgaagccggaatcgctagtaatcgtggatcagcatgccacggtgaatacgttcccgggccttgtacacaccgcccgtcacaccacgagagttggcaacacccgaagtcggtggagtaaccttttggagctagccgccgaaggtggggccaatgattggggtgaagtcgtaacaaggtagccgtatcggaaggtgcggctggatcacctcctttctaa

SEQ ID NO: 873 - DNA, 1431 bp, Tepidibacter mesophilus
  ref <308>: DATABASE ACCESSION NUMBER: NCBI ACCESSION: NZ_BDQY01000058.1
  ref <309>: DATABASE ENTRY DATE: 2019-04-01
  ref <313>: RELEVANT RESIDUES IN SEQ ID NO: (1)..(1431)
ttaatcttagcggcggacgggtgagtaacgcgtgggtaacctgccctatacacacggataacatatcgaaagatatgctaatacgagataatacatttttaaggcatcttaaaaatgtcaaagatttatcggtataggatggacccgcgtcccattagctagttggtgaggtaaaagctcaccaaggcgacgatgggtagccgacctgagagggtgatcggccacactggaactgagacacggtccagactcctacgggaggcagcagtggggaatattgcacaatgggggaaaccctgatgcagcaacgccgcgtgagcgatgaaggccttcgggtcgtaaagctctgtcctaagggaagataatgacggtaccttaggaggaagccccggctaactacgtgccagcagccgcggtaatacgtagggggcaagcgttatccggaattactgggcgtaaagggtgcgtaggcggccttgtaagtcagaagtgaaaggctacggctcaaccgtagtaagcttttgaaactgcagggcttgagtgcaggagaggagagtagaattcctagtgtagcggtgaaatgcgtagatattaggaggaataccagttgcgaaggcggctctctggactgtaactgacgctgaggcacgaaagcgtggggagcgaacaggattagataccctggtagtccacgccgtaaacgatgagtgctaggtgtcgggggttacccccctcggtgccgcagctaacgcattaagcactccgcctggggagtacgctcgcaagagtgaaactcaaaggaattgacggggacccgcacaagtagcggagcatgtggtttaattcgaagcaacgcgaagaaccttacctaagcttgacatccctcagacagcttcttaatcgaagccttcccttcggggactgaggtgacaggtggtgcatggttgtcgtcagctcgtgtcgtgagatgttgggttaagtcccgcaacgagcgcaacccttatctttagttgccagcatttcggatgggcactctagagagactgccgaggataactcggaggaaggtggggatgacgtcaaatcatcatgccccttatgcttagggctacacacgtgctacaatggctagtacagagagttgcgaaaccgcgaggtcaagctaatctcttaaagctagtctcagttcggattgtaggctgaaactcgcctacatgaagctggagttactagtaatcgcgaatcagaatgtcgcggtgaatgcgttcccgggtcttgtacacaccgcccgtcacaccacggaagttgggggcgcccgaagtcagatatccaaccgcaaggaggaatctgccgaaggtgaaatcaatgactggggtgaagtcgtaacaaggtagccgtatcggaaggtgcggctggatcacctcctttcta

SEQ ID NO: 874 - DNA, 1565 bp, Terribacillus aidingensis
  ref <308>: DATABASE ACCESSION NUMBER: NCBI ACCESSION: NZ_OBEK01000011.1
  ref <309>: DATABASE ENTRY DATE: 2019-04-01
  ref <313>: RELEVANT RESIDUES IN SEQ ID NO: (1)..(1565)
ttcatggagagtttgatcttggctcaggacgaacgctggcggcgtgcctaatacatgcaagtcgagcgcaggaagctagatgaccccttcggggtgattctagtggaatgagcggcggacgggtgagtaacacgtgggcaacctgcctgtaagactgggataactccgggaaaccggggctaataccggatagtattttctttctcctgattgaaaatggaaagacggtttcggctgtcacttacagatgggcccgcggtgcattagctagttggtggggtaatggcccaccaaggcgacgatgcatagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgtcagggaagaacaagtacgagagtaactgctcgtaccttgacggtacctgaccagaaagccccggctaactacgtgccagcagccgcggtaatacgtagggggcaagcgttgtccggaattattgggcgtaaagggcgtgtaggcggtttcttaagtctgatgtgaaagcccacagcttaactgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatccgctgacaaccttggagacaaggcattcccttcggggacagcgtgacaggtggtgcatggttgtcgtcagctcgtgtcgtgagatgttgggttaagtcccgcaacgagcgcaacccttgattctagttgccagcattcagttgggcactctagagtgactgccggtgacaaaccggaggaaggtggggatgacgtcaaatcatcatgccccttatgacctgggctacacacgtgctacaatggatggtacaaagggcagcaagaccgcgaggttaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggatcaatgattggggtgaagtcgtaacaaggtagccgtatcggaaggtgcggctggatcacctcctttcta

SEQ ID NO: 875 - DNA, 1566 bp, Terribacillus goriensis
  ref <308>: DATABASE ACCESSION NUMBER: NCBI ACCESSION: NZ_KZ614143.1
  ref <309>: DATABASE ENTRY DATE: 2019-04-01
  ref <313>: RELEVANT RESIDUES IN SEQ ID NO: (1)..(1566)
ttcatggagagtttgatcttggctcaggacgaacgctggcggcgtgcctaatacatgcaagtcgagcgcaggaaaccagatgaccccttcggggtgattctggtggaatgagcggcggacgggtgagtaacacgtgggcaacctgcctgtaagactgggataacttcgggaaaccggagctaataccggatagtatttcctttctcctgattggaaatggaaagacggtttcggctgtcacttacagatgggcccgcggtgcattagctagttggtggggtaatggcccaccaaggcgacgatgcatagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtacgagagtaactgctcgtaccttgacggtacctaaccagaaagccccggctaactacgtgccagcagccgcggtaatacgtagggggcaagcgttgtccggaattattgggcgtaaagggctcgtaggcggtttcttaagtctgatgtgaaagcccacagctcaactgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggagcgaaagcgtggggagcaaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatccgctgacaatcttggagacaagacgttcccttcggggacagcgtgacaggtggtgcatggttgtcgtcagctcgtgtcgtgagatgttgggttaagtcccgcaacgagcgcaacccttgattctagttgccagcattaagttgggcactctagagtgactgccggtgacaaaccggaggaaggtggggatgacgtcaaatcatcatgccccttatgacctgggctacacacgtgctacaatggatggtacaaagggcagcaaagtcgcgaggctaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttaggagccagccgccgaaggtgggatcaatgattggggtgaagtcgtaacaaggtagccgtatcggaaggtgcggctggatcacctcctttcta

SEQ ID NO: 876 - DNA, 1057 bp, Terribacillus saccharophilus
  ref <308>: DATABASE ACCESSION NUMBER: NCBI ACCESSION: NZ_FOCD01000013.1
  ref <309>: DATABASE ENTRY DATE: 2019-04-01
  ref <313>: RELEVANT RESIDUES IN SEQ ID NO: (1)..(1057)
tctcctgattggaaatggaaagacggtttcggctgtcacttacagatgggcccgcggtgcattagctagttggtggggtaatggcccaccaaggcgacgatgcatagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtacgagagtaactgctcgtaccttgacggtacctaaccagaaagccccggctaactacgtgccagcagccgcggtaatacgtagggggcaagcgttgtccggaattattgggcgtaaagggctcgtaggcggtttcttaagtctgatgtgaaagcccacagctcaactgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggagcgaaagcgtggggagcaaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatccgctgacaatcttggagacaagacgttcccttcggggacagcgtgacaggtggtgcatggttgtcgtcagctcgtgtcgtgagatgttgggttaagtcccgcaacgagcgcaacccttgattctagttgccagcattaagttgggcactctagagtgactgccggtgacaaaccggaggaaggtggggatgacgtcaaatcatcatgccccttatgacctgggctacacacgtgctacaa

SEQ ID NO: 877 - DNA, 420 bp, Terribacillus sp. 7520-G
  ref <308>: DATABASE ACCESSION NUMBER: NCBI ACCESSION: NZ_NQFP01000070.1
  ref <309>: DATABASE ENTRY DATE: 2019-04-01
  ref <313>: RELEVANT RESIDUES IN SEQ ID NO: (1)..(420)
ctttattggagagtttgatcctggctcaggacgaacgctggcggcgtgcctaatacatgcaagtcgagcggaatcgatggagtgcttgcactcctgagatttagcggcggacgggtgagtaacacgtaggcaacctgccctcaagactgggataactaccggaaacggtagctaataccggataggatatttggctgcatggccggatatggaaaggcggagcaatctgtcacttgaggatgggcctgcggcgcattagctagttggtggggtaatggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgag

SEQ ID NO: 878 - DNA, 1570 bp, Thalassobacillus cyri
  ref <308>: DATABASE ACCESSION NUMBER: NCBI ACCESSION: NZ_FNQR01000032.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcgggaagcaagcggatccccttcgggggtgacgcttgtggaacgagcggcggacgggtgagtaacacgtgggcaacctgcctgtaagactgggataaccccgggaaaccggggctaataccggataacaccggactccacatggagtcgggttgaaagatggcttcttgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgtcagggaagaacaagtgccgtgcgaatagagcggcaccttgacggtacctgacgaggaagccccggctaactacgtgccagcagccgcggtaatacgtagggggcaagcgttgtccggaattattgggcgtaaagcgcgcgcaggcggtttcttaagtctgatgtgaaagcccacggctcaaccgtggagggtcattggaaactggggaacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcttcggacaaccctggagacagggcgttcccttcggggaccgaatgacaggtggtgcatggttgtcgtcagctcgtgtcgtgagatgttgggttaagtcccgcaacgagcgcaacccctgaccttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttcta

SEQ ID NO: 879 - DNA, 1506 bp, Thermoactinomyces sp. DSM 45892
  ref <308>: DATABASE ACCESSION NUMBER: NCBI ACCESSION: NZ_FNPL01000042.1
  ref <309>: DATABASE ENTRY DATE: 2019-04-01
  ref <313>: RELEVANT RESIDUES IN SEQ ID NO: (1)..(1506)
ggagagtttgatcctggctcaggacgaacgctggcggcgtgcctaatacatgcaagtcgagcgaggagcttttagctcctagcggcgaacgggtgagtaacacgtgggcaacctgcccgtaagactgggataacttcgggaaaccggagctaatactggataatcttgatcttcgcatgaaggacaagtaaaagatttatcacttacggatgggcccgcggtgcattagcttgttggtggggtaatggcctaccaaggcgacgatgcatagccgacctgagagggtgaccggccacactgggactgagacacggcccagactcctacgggaggcagcagtagggaattttccgcaatgggcgaaagcctgacggagcaacgccgcgtgaatgatgacggccttcgggttgtaaaattctgttctaagggaagaagttctgacggtaccttaggagaaagccacggctaactacgtgccagcagccgcggtaatacgtaggtggcaagcgttgtccggaattattgggcgtaaagcgcgcgcaggcggttctttaagttgggtgttaaaggcagcggctcaaccgctgttcgcacccaaaactggggaacttgagtgcaggagaggatagtggaattcccggtgtagcggtggaatgcgtagagatcgggaggaacaccagtggcgaaggcgactgtctggcctgcaactgacgctgaggcgcgaaagcgtggggagcaaacaggattagataccctggtagtccacgccgtaaacgatgagtgctaggtgttgggggcttcccgccctcagtgccgaagttaacacagtaagcactccgcctggggagtacggccgcaaggttgaaactcaaaggaattgacgggggcccgcacaagcggtggagcatgtggtttaattcgaagcaacgcgaagaaccttaccaaggcttgacatccctctgtaaactctagagatagagtccctcttcggagcagaggtgacaggtggtgcatggttgtcgtcagctcgtgtcgtgagatgttgggttcagtcccgcaacgagcgcaacccttatcgttagttgccagcagcttggctgggcactctaacgagacagccggtgaaagccggaggaaggtggggatgacgtcaaatcatcatgccccttatgtcttgggctacacacgtgctacaatggctggtacaaagagtcgctaaatcgtgagatcatgctaatctcataaaaccagtctcagttcggattgtaggctgcaactcgcctacatgaagctggaatcgctagtaatcgcggatcagcatgccgcggtgaatacgttcccgggccttgtacacaccgcccgtcacaccacgggagtttgtcacacccgaagtcggtgaggtaaccttttggagccagccgcctaaggtggggcagatgactggggtgaagtcgtaacaaggtatccctaccggaaggtggggatggatcacctcctttctatgga

SEQ ID NO: 880 - DNA, 292 bp, Thermoactinomyces vulgaris
  ref <308>: DATABASE ACCESSION NUMBER: NCBI ACCESSION: NZ_REFP01000010.1
  ref <309>: DATABASE ENTRY DATE: 2019-04-01
  ref <313>: RELEVANT RESIDUES IN SEQ ID NO: (1)..(292)
gaacccgcgagggggagccaatcccaaaaagccagtctcagttcggatcgcaggctgcaactcgcctgcgtgaagccggaatcgctagtaatcgcggatcagcatgccgcggtgaatacgttcccgggccttgtacacaccgcccgtcacaccacgagagtttgcaacacccgaagtcggtgaggcaaccttttaggagccagccgccgaaggtggggcagatgattggggtgaagtcgtaacaaggtatccctaccggaaggtggggatggatcacctcctttctaaggag

SEQ ID NO: 881 - DNA, 1808 bp, Thermoanaerobacter ethanolicus
  ref <308>: DATABASE ACCESSION NUMBER: NCBI ACCESSION: NZ_CP033580.1
  ref <309>: DATABASE ENTRY DATE: 2019-04-01
  ref <313>: RELEVANT RESIDUES IN SEQ ID NO: (1)..(1808)
gagagtttgatcctggctcaggacgaacgctggcggcgtgcctaacacatgcaagtcgagcggtccggcactcaactaagtgcttacttaaggggaaggaagtatagtagaagaagaaggtaataaaagtgatgcaaagtaaggtaagcgcggagttgagtgccggatagcggcggacgggtgagtaacgcgtgggcaacctacccttaagaccgggataacacctcgaaaggggtgctaatactggataagctccttgtagggcatcctatgaggagggaaggtagcggaagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgcgcaatgggcgaaagcctgacgcagcgacgccgcgtgagcgaagaaggccttcgggtcgtaaagctcgatagtgtgggaagaatagatgacggtaccacacgaaagccccggctaactacgtgccagcagccgcggtaagacgtagggggcgagcgttgtccggaattactgggcgtaaagggcgcgtaggcggccacttaagtcaggtgtaaaaaacccgggctcaacccgggggatgcacatgaaactgggtggctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgccgtaaacgatgggtactaggtgtgggatgcggaagcattccgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgacccggcactcaacgaagtgcttaccgtagagaagaagtaggtagggagtaaatgcaggaaggaagagttaagaggtaggcgcttggttgagtgccgggagcctgcacaggtggtgcatggttgtcgtcagctcgtgtcgtgagatgttgggttaagtcccgcaacgagcgcaacccttgcttctagttgccagtccgtcactcaactgaacatgttaggaaagagtagagaggaagggatagcatgttcagttgagtgacggaggcactctagagggactgccgtggacaacacggaggaaggtggggatgacgtcaaatcatcatgccctatatgccctgggccacacacgtgctacaatggccggtacagagggaggcgaagccgcgaggcggagcggaacccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagtctgcaacacccgaagccggtgacccaacccggcactcaagtggacatgggattatagggaagaaagaagatataatacgtgtccacttgagtgccgggagggagccgtcgaaggtggggcagatgattggggtgaagtcgtaacaaggtagccgtatcggaaggtgcggctggatcacctcctttct

SEQ ID NO: 882 - DNA, 1615 bp, Thermobacillus composti
  ref <308>: DATABASE ACCESSION NUMBER: NCBI ACCESSION: NC_019897.1
  ref <309>: DATABASE ENTRY DATE: 2019-04-01
  ref <313>: RELEVANT RESIDUES IN SEQ ID NO: (1)..(1615)
cctttaatggagagtttgatcctggctcaggacgaacgctggcggcgtgcctaatacatgcaagtcgagcggagctttcgcggcggaagccttcgggtggaagctgcgaaagcttagcggcggacgggtgagtaacacgtgggcaacctgcccgaaagaccgggataacatccggaaacggatgctaataccggataagcggacctttcgcatgaagggttcgggaaagacggggcaacctgtcactttcggatgggcccgcggcgcattagctggttggcggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaggaaggtcttcggatcgtaaagctctgttgccagggaagaatcccctggggagtcactgccccggggttgacggtacctgagaagaaagccccggctaactacgtgccagcagccgcggtaatacgtagggggcgagcgttgtccggaattattgggcgtaaagcgcgcgcaggcggttttgtaagtccgattgtttaaacccggggctcaacctcgggtcgcaagggaaactgcaagacttgagtgcaggagagggaagcggaattccatgtgtagcggtgaaatgcgtagagatatggaggaacaccagtggcgaaggcggcttcctggcctgtaactgacgctgaggcgcgaaagcgtggggagcaaacaggattagataccctggtagtccacgccgtaaacgatgaatgctaggtgtcaggggtttcgagacccttggtgccgaagttaacacattaagcattccgcctggggagtacggccgcaaggctgaaactcaaaggaattgacggggacccgcacaagcagtggagcatgtggtttaattcgaagcaacgcgaagaaccttaccaggtcttgacatccctctgaatacgccagagatggggtaggcccttcggggacagaggagacaggtggtgcatggttgtcgtcagctcgtgtcgtgagatgttgggttaagtcccgcaacgagcgcaacccttaggtctagttgccagcacttcgggtgggcactctagagcgactgccggtgacaaaccggaggaaggcggggatgacgtcaaatcatcatgccccttatgacctgggctacacacgtgctacaatggccggtacaaagggcagcgaagccgcgaggcggagccaatcccaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagccggtggggtaacctgagagtttgcggagcaaacttgcttcggaagcgttgacccaggagccagccgtcgaaggtggggcagatgattggggtgaagtcgtaacaaggtagccgtatcggaaggtgcggctggatcacctcctttctaagga

SEQ ID NO: 883 - DNA, 1530 bp, Thermoflavimicrobium dichotomicum
  ref <308>: DATABASE ACCESSION NUMBER: NCBI ACCESSION: NZ_FORR01000062.1
  ref <309>: DATABASE ENTRY DATE: 2019-04-01
  ref <313>: RELEVANT RESIDUES IN SEQ ID NO: (1)..(1530)
ttttttggagagtttgatcctggctcaggatgaacgctggcggcgtgcctaatacatgcaagtcgagcggggttatttccttcgggaaataacctagcggcgaacgggtgagtaacacgtgggcaacctgcccctaagactgggataactccgggaaaccggggctaataccagataacctcttccctcgcatgagggaagagtaaaaggcttttgccacttagggatgggcccgcggcgcattagctagttggtgaggtaacggctcaccaaggcgacgatgcgtagccgacctgagagggtgaccggccacactgggactgagacacggcccagactcctacgggaggcagcagtagggaattttccgcaatgggcgaaagcctgacggagcaacgccgcgtgagcgaagacggccttcgggttgtaaagctctgttcttggggaagaaggaagtgacggtacccaaggagaaagccccggctaactacgtgccagcagccgcggtaatacgtagggggcgagcgttatccggaattattgggcgtaaagcgcgcgcaggcggccaggtaagtcggatgtgaaaggctacggctcaaccgtagagcggcatccgaaactgtctggcttgagtgcaggagaggggagcggaattcccggtgtagcggtggaatgcgtagagatcgggaggaacaccagtggcgaaggcggctctctggcctgtaactgacgctgaggcgcgaaagcgtggggagcaaacaggattagataccctggtagtccacgccgtaaacgatgagtgctaggtgttggagggactctcccttcagtgccgcaggtaacccaataagcactccgcctggggagtacggtcgcaagactgaaactcaaaggaattgacgggggcccgcacaagcggtggagcatgtggtttaattcgaagcaacgcgaagaaccttaccagggcttgacatcccgctgaccggtgtagagatacgcctttccccttcgggggacagcggtgacaggtggtgcatggttgtcgtcagctcgtgtcgtgagatgttgggttcagtcccgcaacgagcgcaacccttatctccagttgccagcacttcgggtgggcactctggagagacagccggtgaaagccggaggaaggtggggatgacgtcaaatcatcatgccccttatgtcctgggctacacacgtgctacaatggctggtacaaagggcagcgaacccgcgagggggagccaatcccaaaaagccagtctcagttcggattgcaggctgcaactcgcctgcatgaagccggaatcgctagtaatcgcggatcagcatgccgcggtgaatacgttcccgggccttgtacacaccgcccgtcacaccacgagagtctgcaacacccgaagtcggtgaggcaaccgcaaggagccagccgccgaaggtggggcagatgattggggtgaagtcgtaacaaggtatccctaccggaaggtggggatggatcacctcctttctacggag

SEQ ID NO: 884 - DNA, 539 bp, Thermoflavimicrobium sp. FBKL4.011
  ref <308>: DATABASE ACCESSION NUMBER: NCBI ACCESSION: NZ_KZ845663.1
  ref <309>: DATABASE ENTRY DATE: 2019-04-01
  ref <313>: RELEVANT RESIDUES IN SEQ ID NO: (1)..(539)
tagagatataccttcccttcggggcagcggtgacaggtggtgcatggttgtcgtcagctcgtgtcgtgagatgttgggttcagtcccgcaacgagcgcaacccttatctttagttgccagcaggtcaagctgggcactctagagagacagccggtgaaagccggaggaaggtggggatgacgtcaaatcatcatgccccttatgtcctgggctacacacgtgctacaatggctggtacaatgggatgcgataccgcgaggtgaagccaatcccaaaaagccagtctcagttcggattgcaggctgcaactcgcctgcatgaagtcggaatcgctagtaatcgcggatcagcatgccgcggtgaatacgttcccgggccttgtacacaccgcccgtcacaccacgagagtttgcaacacccgaagtcggtgagggaacctcacggacccagccgccgaaggtggggcagatgattggggtgaagtcgtaacaaggtatccctaccggaaggtggggatggatcacctcctttctacggag

SEQ ID NO: 885 - DNA, 1568 bp, Virgibacillus dakarensis
  ref <308>: DATABASE ACCESSION NUMBER: NCBI ACCESSION: NZ_LT732554.1
  ref <309>: DATABASE ENTRY DATE: 2019-04-01
  ref <313>: RELEVANT RESIDUES IN SEQ ID NO: (1)..(1568)
ttttttggagagtttgatcttggctcaggacgaacgctggcggcgtgcctaatacatgcaagtcgagcgcgggaagcaagcggaatccttcgggaggacgctagtggaacgagcggcggacgggtgagtaacacgtgggcaacctgcctgtaagatcgggataactccgggaaaccggggctaataccggataatactttttctcgcgtggggagaagttgaaagatggcttcggctatcgcttacagatgggcccgcggcgcattagctagttggtagggtaacggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtgagggaagaacaagtaccgttcgaagagggcggtaccgtgacggtacctcaccagaaagccccggctaactacgtgccagcagccgcggtaatacgtagggggcaagcgttgtccggaattattgggcgtaaagcgcgcgcaggcggtcttttaagtctgatgtgaaatctcgcggctcaaccgcgagcggtcattggaaactggaggacttgagtgcagaagaggagagtggaattccacgtgtagcggtgaaatgcgtagagatgtggaggaacaccagtggcgaaggcgactctctggtctgtaactgacgctgaggtgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgctagcgctagagatagggtgttcccttcggggacagagagacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggcagcgaagccgcaaggtgaagcaaatcccataaaaccattcccagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaaccatttggagccagccgccgaaggtggggccaatgattggggtgaagtcgtaacaaggtagccgtatcggaaggtgcggctggatcacctcctttctaa

SEQ ID NO: 886 - DNA, 1569 bp, Virgibacillus indicus
  ref <308>: DATABASE ACCESSION NUMBER: NCBI ACCESSION: NZ_NPMS01000020.1
  ref <309>: DATABASE ENTRY DATE: 2019-04-01
  ref <313>: RELEVANT RESIDUES IN SEQ ID NO: (1)..(1569)
tttttggagagtttgatcttggctcaggacgaacgctggcggcgtgcctaatacatgcaagtcgagcgcgggaagcaagctgatctccttcgggagtgacgcttgtggaacgagcggcggacgggtgagtaacacgtgggcaacctgcctgtaagatcgggataactcgcggaaacgtgagctaataccggataattcttttcactgcctggtgagaaggtgaaaggtggcttttagctaccacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtatcgttcaaatagggcggtaccttgacggtacctgaccagaaagccccggctaactacgtgccagcagccgcggtaatacgtagggggcaagcgttgtccggaattattgggcgtaaagcgctcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgatggcggtagagataccgtgttcccttcggggacagagtgacaggtggtgcatggttgtcgtcagctcgtgtcgtgagatgttgggttaagtcccgcaacgagcgcaacccttaggtctagttgccagcatttagttgggcactctagagtgactgccggtgacaaaccggaggaaggtggggacgacgtcaaatcatcatgccccttatgacctgggctacacacgtgctacaatggatggaacaaagggcagcgaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 887 - DNA, 1572 bp, Virgibacillus massiliensis
  ref <308>: DATABASE ACCESSION NUMBER: NCBI ACCESSION: NZ_CCDP010000001.1
  ref <309>: DATABASE ENTRY DATE: 2019-04-01
  ref <313>: RELEVANT RESIDUES IN SEQ ID NO: (1)..(1572)
tttattggagagtttgatcttggctcaggacgaacgctggcggcgtgcctaatacatgcaagtcgagcgcgggaagcaggcagaactccttcgggagtgatgcctgtggaacgagcggcggacgggtgagtaacacgtgggcaacctgcctgtaagactgggataaccccgggaaaccggggctaataccggataacactttttggtacatgccaagaagttgaaaggcggcctttttggctgtcacttacagatgggcccgcggcgcattagctagttggtagggtaacggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccgttcaaatagggcggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggctcaaccgtggatggccattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtggggagcgaacaggattagataccctggtagtccacgccgtaaacgttgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacacccctagagatagggcattcccttcggggacagagtgacaggtggtgcatggttgtcgtcagctcgtgtcgtgagatgttgggttaagtcccgcaacgagcgcaacccttgatcttagttgccagcattgagttgggcactctaaggtgactgccggtgacaaaccggaggaaggtggggatgacgtcaaatcatcatgccccttatgacctgggctacacacgtgctacaatggatggaacaaagggcagcgaaaccgcaaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 888 - DNA, 1569 bp, Virgibacillus ndiopensis
  ref <308>: DATABASE ACCESSION NUMBER: NCBI ACCESSION: NZ_FZMZ01000003.1
  ref <309>: DATABASE ENTRY DATE: 2019-04-01
  ref <313>: RELEVANT RESIDUES IN SEQ ID NO: (1)..(1569)
ttttttggagagtttgatcttggctcaggacgaacgctggcggcgtgcctaatacatgcaagtcgagcgcgggaagcaaactctgcccttcggggcgtgcgtttgtggaacgagcggcggacgggtgagtaacacgtgggcaacctgcctgtaagactgggataaccccgggaaaccggggctaataccggataacacttttcatcacatggtgagaagttgaaaggcggcactagctgtcacttacagatgggcccgcggcgcattagctagttggtggggtaatggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcaaatagggcggtaccttgacggtacctaaccagaaagccccggctaactacgtgccagcagccgcggtaatacgtagggggcaagcgttgtccggaattattgggcgtaaagcgcgcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaacatggtagagatatcgttttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggcagcgaagccgcgaggtgaagcaaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagttggcaacacccgaagtcggtgaggtaaccttttggagccagccgccgaaggtggggccaatgattggggtgaagtcgtaacaaggtagccgtatcggaaggtgcggctggatcacctcctttctaa

SEQ ID NO: 889 - DNA, 1571 bp, Virgibacillus necropolis
  ref <308>: DATABASE ACCESSION NUMBER: NCBI ACCESSION: NZ_CP022437.1
  ref <309>: DATABASE ENTRY DATE: 2019-04-01
  ref <313>: RELEVANT RESIDUES IN SEQ ID NO: (1)..(1571)
ttttttggagagtttgatcttggctcaggacgaacgctggcggcgtgcctaatacatgcaagtcgagcgcgggaagcaagcaatcactcttcggggtgtgagcttgtggaacgagcggcggacgggtgagtaacacgtgggcaacctacctgtaagattgggataacctcgggaaaccggagctaataccgaataatactttttatcacatgatagaaagttgaaaggcggcttttgctgtcacttacagatgggcccgcgtcgcattagctagttggtggggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcgttcgaatagggcggtaccatgacggtacctaaccagaaagccccggctaactacgtgccagcagccgcggtaatacgtagggggcaagcgttgtccggaattattgggcgtaaagcgctcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgatagcgatagagatatcgtgttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggacgcgaagccgcgaggtgtagcaaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttctaa

SEQ ID NO: 890 - DNA, 1571 bp, Virgibacillus phasianinus
  ref <308>: DATABASE ACCESSION NUMBER: NCBI ACCESSION: NZ_CP022315.1
  ref <309>: DATABASE ENTRY DATE: 2019-04-01
  ref <313>: RELEVANT RESIDUES IN SEQ ID NO: (1)..(1571)
ttttttggagagtttgatcttggctcaggacgaacgctggcggcgtgcctaatacatgcaagtcgagcgcgggaagcaagtaatcgcccttcggggcgtgagcttgtggaacgagcggcggacgggtgagtaacacgtgggcaacctgcctgtaagattgggataaccccgggaaaccggagctaataccgaataatactttttatcacatggtagaaagttgaaaggcggcttttgctgtcacttacagatgggcccgcggcgcattagctagttggtggggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacacgtatcgttcgaataggacggtgctttgacggtacctaaccagaaagccccggctaactacgtgccagcagccgcggtaatacgtagggggcaagcgttgtccggaattattgggcgtaaagcgctcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgccagcgatagagatatcgtgttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggaagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttctaa

SEQ ID NO: 891 - DNA, 1569 bp, Virgibacillus profundi
  ref <308>: DATABASE ACCESSION NUMBER: NCBI ACCESSION: NZ_NPMW01000029.1
  ref <309>: DATABASE ENTRY DATE: 2019-04-01
  ref <313>: RELEVANT RESIDUES IN SEQ ID NO: (1)..(1569)
tttttggagagtttgatcttggctcaggacgaacgctggcggcgtgcctaatacatgcaagtcgagcgcgggaagcaagggatcacccttcggggtgtgaacttgtggaacgagcggcggacgggtgagtaacacgtgggcaacctgcctgtaagatcgggataacttgcggaaacgtgagctaataccggataatacttttcattacataatgggaagttgaaagatggcttttagctatcacttacagatgggcccgcggcgcattagctagttggtgaggtaactgctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttggggaagaacaagtaccgttcaaatagggcggtaccttgacggtacctaaccagaaagccccggctaactacgtgccagcagccgcggtaatacgtagggggcaagcgttgtccggaattattgggcgtaaagcgctcgcaggcggtcttttaagtctgatgtgaaagcccacggcttaaccgtggagggtcattggaaactggaggacttgagtacagaagaggagagtggaataccacgtgtagcggtgaaatgcgtagagatgtggtggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgatagcggtagagataccgtgttcccttcggggacagagtgacaggtggtgcatggttgtcgtcagctcgtgtcgtgagatgttgggttaagtcccgcaacgagcgcaacccttaggtctagttgccagcattaagttgggcactctagagtgactgccggtgacaaaccggaggaaggtggggacgacgtcaaatcatcatgccccttatgacctgggctacacacgtgctacaatggatggaacaaagggcagcgaaaccgcaaggtcaagcaaatcccataaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 892 - DNA, 1569 bp, Virgibacillus salinus
  ref <308>: DATABASE ACCESSION NUMBER: NCBI ACCESSION: NZ_FNKD01000009.1
  ref <309>: DATABASE ENTRY DATE: 2019-04-01
  ref <313>: RELEVANT RESIDUES IN SEQ ID NO: (1)..(1569)
tttatggagagtttgatcttggctcaggacgaacgctggcggcgtgcctaatacatgcaagtcgagcgcgggaagcagacggatcccttcggggtgaagtttgtggaacgagcggcggacgggtgagtaacacgtgggcaacctacctgtaagactgggataaccccgggaaaccggggctaataccggataacatttttcagcacatgttgagaaattgaaaggcggcttttagctgtcacttacagatgggcccgcggcgcattagttagttggtagggtaacggcctaccaaggcgacgatgcgtagccgacctgagagggtgatcggccacactgggactgagacacggcccagactcctacgggaggcagcagtagggaatcatccgcaatggacgaaagtctgacggtgcaacgccgcgtgagtgatgaaggttttcggatcgtaaaactctgttgttagggaagaacaagtaccgtttgaataaggcggtaccttgacggtacctaaccagaaagccccggctaactacgtgccagcagccgcggtaatacgtagggggcaagcgttgtccggaattattgggcgtaaagcgctcgcaggcggtcttttaagtctgatgtgaaagcccacggctcaaccgtggagggtcattggaaactggaggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgcaagcggtagagataccgtgttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggcagcgaagccgcaaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaaccattatggagccagccgccgaaggtggggccaatgattggggtgaagtcgtaacaaggtagccgtatcggaaggtgcggctggatcacctcctttctaa

SEQ ID NO: 893 - DNA, 1569 bp, Virgibacillus senegalensis
  ref <308>: DATABASE ACCESSION NUMBER: NCBI ACCESSION: NZ_LN611423.1
  ref <309>: DATABASE ENTRY DATE: 2019-04-01
  ref <313>: RELEVANT RESIDUES IN SEQ ID NO: (1)..(1569)
tttatggagagtttgatcttggctcaggacgaacgctggcggcgtgcctaatacatgcaagtcgagcgcgggaagcaggcagatcccttcggggtgaaacctgtggaacgagcggcggacgggtgagtaacacgtgggcaacctgcctgtaagatcgggataactccgggaaaccggggctaataccgggtaatactttcttccgcatggagggaagttgaaaggcggccttttggctgtcacttacagatgggcccgcggcgcattagctagttggtggggtaatggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgtcagggaagaacaagtaccgtttgaacaaggcggtaccttgacggtacctgacgaggaagccccggctaactacgtgccagcagccgcggtaatacgtagggggcaagcgttgtccggaattattgggcgtaaagcgcgcgcaggcggttccttaagtctgatgtgaaagcccacggcttaaccgtggagggtcattggaaactggggaacttgagtacagaagaggagagcggaattccacgtgtagcggtgaaatgcgtagatatgtggaggaacaccagtggcgaaggcggctctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacccctctagagatagaggtttcccttcggggacagagtgacaggtggtgcatggttgtcgtcagctcgtgtcgtgagatgttgggttaagtcccgcaacgagcgcaacccttgaccttagttgccagcattcagttgggcactctagggtgactgccggtgacaaaccggaggaaggtggggatgacgtcaaatcatcatgccccttatgacctgggctacacacgtgctacaatggatggtacaaagggaagcgaaaccgcgaggtgaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttcta

SEQ ID NO: 894 - DNA, 325 bp, Virgibacillus sp. 7505
  ref <308>: DATABASE ACCESSION NUMBER: NCBI ACCESSION: NZ_NPBF01000089.1
  ref <309>: DATABASE ENTRY DATE: 2019-04-01
  ref <313>: RELEVANT RESIDUES IN SEQ ID NO: (1)..(325)
acacacgtgctacaatggatggtacaaagggcagcgaagccgcgaggtgaagccaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagttggtaacacccgaagtcggtgaggtaaccttttggagccagccgccgaaggtgggatcaatgattggggtgaagtcgtaacaaggtagccgtatcggaaggtgcggctggatcacctcctttctaagga

SEQ ID NO: 895 - DNA, 1568 bp, Virgibacillus sp. Bac330
  ref <308>: DATABASE ACCESSION NUMBER: NCBI ACCESSION: NZ_CP033048.1
  ref <309>: DATABASE ENTRY DATE: 2019-04-01
  ref <313>: RELEVANT RESIDUES IN SEQ ID NO: (1)..(1568)
tttatggagagtttgatcttggctcaggacgaacgctggcggcgtgcctaatacatgcaagtcgagcgcgggaagcaagcagatctccttcgggagtgacgcttgtggaacgagcggcggacgggtgagtaacacgtgggcaacctacctgtaagactgggataactccgggaaaccggggctaataccggatgaaacaaagcgtcgcatgacgcaatgttaaaaggcggcatatgctgtcacttacagatgggcccgcggcgcattagctagttggtgaggtaaaggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccattcgaataggttggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggccattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacacccctagagatagggcattcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggcagcgaagccgcgaggccaagcaaatcccataaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 896 - DNA, 1569 bp, Virgibacillus sp. Bac332
  ref <308>: DATABASE ACCESSION NUMBER: NCBI ACCESSION: NZ_CP033046.1
  ref <309>: DATABASE ENTRY DATE: 2019-04-01
  ref <313>: RELEVANT RESIDUES IN SEQ ID NO: (1)..(1569)
tttttggagagtttgatcttggctcaggacgaacgctggcggcgtgcctaatacatgcaagtcgagcgcgggaagcaggcagatcctctccggaggtgacgcctgtggaacgagcggcggacgggtgagtaacacgtgggcaacctgcctgtaagattgggataaccccgggaaaccggggctaataccggataatacttttcgttgcataacgagaagttgaaaggcggcttttagctgtcacttacagatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccgttcaaatagggcggcaccttgacggtacctgaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggccattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgccaatcctagagataggatgttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggcagcgaagccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 897 - DNA, 1570 bp, Virgibacillus sp. LJ137
  ref <308>: DATABASE ACCESSION NUMBER: NCBI ACCESSION: NZ_QTSZ01000034.1
  ref <309>: DATABASE ENTRY DATE: 2019-04-01
  ref <313>: RELEVANT RESIDUES IN SEQ ID NO: (1)..(1570)
tttttggagagtttgatcttggctcaggacgaacgctggcggcgtgcctaatacatgcaagtcgagcgcgggaagcaaacagatctccttcgggagtgacgtttgtggaacgagcggcggacgggtgagtaacacgtgggcaacctgcctgtaagactgggataactccgggaaaccggggctaataccggataatccttcttgccacatggtgaggagtcaaaaggcggcttttagctgtcacttacagatgggcccgcggcgcattagctagttggtggggtaaaggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggtcttcggatcgtaaaactctgttgtcagggaagaacaagtatggtagtaactgaccgtaccttgacggtacctgaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaccactctagagatagagtcttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacagagggcagcgaaaccgcgaggtgaagcaaatcccacaaaaccattctcagttcggattgtaggctgcaattcgcctacatgaagcaggaatcgctagtaatcgcggatcagaatgccgcggtgaatacgttcccgggccttgtacacaccgcccgtcacaccacgagagttagcaacacccgaagtcggtgaggtaaccatttatggagccagccgccgaaggtggggccaatgattggggtgaagtcgtaacaaggtagccgtatcggaaggtgcggctggatcacctcctttcta

SEQ ID NO: 898 - DNA, 1247 bp, Virgibacillus subterraneus
  ref <308>: DATABASE ACCESSION NUMBER: NCBI ACCESSION: NZ_FOEH01000014.1
  ref <309>: DATABASE ENTRY DATE: 2019-04-01
  ref <313>: RELEVANT RESIDUES IN SEQ ID NO: (1)..(1247)
gcttttagctgtcacttacagatgggcccgcggcgcattagttagttggtagggtaacggcctaccaaggcgacgatgcgtagccgacctgagagggtgatcggccacactgggactgagacacggcccagactcctacgggaggcagcagtagggaatcatccgcaatggacgaaagtctgacggtgcaacgccgcgtgagtgatgaaggttttcggatcgtaaaactctgttgttagggaagaacaagtaccgtttgaataaggcggtaccttgacggtacctaaccagaaagccccggctaactacgtgccagcagccgcggtaatacgtagggggcaagcgttgtccggaattattgggcgtaaagcgctcgcaggcggtcttttaagtctgatgtgaaagcccacggctcaaccgtggagggtcattggaaactggaggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgcaagcggtagagataccgtgttcccttcggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggaacaaagggcagcgaagccgcaaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaaccatt

SEQ ID NO: 899 - DNA, 1510 bp, Abditibacterium utsteinense
  ref <308>: DATABASE ACCESSION NUMBER: NCBI ACCESSION: NZ_NIGF01000045.1
  ref <309>: DATABASE ENTRY DATE: 2019-04-01
  ref <313>: RELEVANT RESIDUES IN SEQ ID NO: (1)..(1510)
tcaatggagagtttgatcctggctcaggacgaacgctggcggcgtggattaggcatgcaagtcgagcgacggaccttcgggttacggagcggcgaacgggtgagtaacacgtgaataacctaccctctcattccggataattggccgaaaggccttgtaatacgggggaggttccactttaggcatctttagtggaacgaacaggcaactggtgcgaggaggggttcgcggattatcaggtagttggtggggtaatggcctaccaagcctacgacgattagctggtctgagaggatggtcagccacattggaactgagatactgtccagactcttacgggaggctgcagtcgagaatcttgggcaatgcacgaaagtgtgacccagcgacgccgcgtgaaggatgaaggccctctgggttgtaaacttcttttacgggagaagaataaatgacggtatcccgtgaataagccacggctaactacgtgccagcagccgcggtaatacgtaggtggcaagcgttgtccggatttactgggcgtaaagcgaacgcaggcggactgttaagtagaaagtgaaaggtcggagctcaactccaacattgcttcctatactggcagtcttgagtagcggagaggaagggggaacgacacgtgtagcggtgaaatgcgttgatatgtgtcggaacacccatggcgaaagcacccttctggacgcaaactgacgctcaggttcgaaagccaaggtagcgaacaggattagataccctggtagtcttggccctaaactatgttcactaggtgtcggggggtttccttcggtgccgcagctaacgcattaagtgaaccgcctggggactacggccgcaaggttgaaactcaaaggaattggcgggggcccgcacaagcggtggagcatatggcttaattcgatgcaacgcgaagaaccttaccagggcttgacatgtacctgcaatcccccgaaaaggggccgccttcgagggtggtacacaggtggtgcatggctgtcgtcagctcgtgttgtgaaatgttgggttaagtcccgcaacgagcgcaactctcatgttttgttaccagcggataatgccggggactcgagacaaactgcctctgtaaagaggaggaaggtgggaacgacgtcaagtcatcatgccccttacgccctgggctgcacatatgctacaatggcgtctacaaagggttgctaacctgcgaaggtatgctaatctcaaaaaaggcgtctcagttcggattggagtctgcaactcgactccatgaagttggaatcgctagtaaccgcaggtcagcaatactgcggtgaatacgttcccgggccttgcacacaccgcccgtcacatgacgaaagttggtattacccgaagtcgccgggctaaccgcaaggaagcaagcgccgaaggtagtgccgatgattggcgtgaagtcgtaacaaggtagccgtatcggaaggtgcggctggatcacctcctttct

SEQ ID NO: 900 - DNA, 1563 bp, Abiotrophia defectiva
  ref <308>: DATABASE ACCESSION NUMBER: NCBI ACCESSION: NZ_KI535341.1
  ref <309>: DATABASE ENTRY DATE: 2019-04-01
  ref <313>: RELEVANT RESIDUES IN SEQ ID NO: (1)..(1563)
ttttcatgagagtttgatcctggctcaggacgaacgctggcggcgtgcctaatacatgcaagtcgaacgaaccgcgactgagtgcttgcacttggtcaaggtgagtggcgaacgggtgagtaacacgtgggtaacctacctcatagtgggggataacagtcggaaacgactgctaataccgcataggacatgggatcacatgattctgtgaggaaaggtggcgcaagctatcgctaagagatggacccgcggtgcattagctagttggtagggtaagggcctaccaaggcgatgatgcatagccgacctgagagggtgatcggccacattgggactgagacacggcccaaactcctacgggaggcagcagtagggaatcttccgcaatggacgcaagtctgacggagcaacgccgcgtgagtgaagaaggtcttcggatcgtaaagctctgttgttagagaagaacagcgcatagagtaactgctatgcgtgtgacggtatctaaccagaaagccacggctaactacgtgccagcagccgcggtaatacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggaggggttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatcccgacgaccgctctagagatagagtttttcttcggaacgtcggtgacaggtggtgcatggttgtcgtcagctcgtgtcgtgagatgttgggttaagtcccgcaacgagcgcaacccctataactagttgccagcattgagatggggactctagttagactgccggtgacaaaccggaggaaggtggggatgacgtcaaatcatcatgccccttatgacctgggctacacacgtgctacaatggatggtacaacgagcagcgaactcgcgagggtaagcgaatctctaaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacccgaagccggtggcctaaccttttaggagggagccgtcgaaggtgggatagatgattggggtgaagtcgtaacaaggtagccgtatcggaaggtgcggctggatcacctcctttctaagga

SEQ ID NO: 901 - DNA, 1563 bp, Abiotrophia sp. HMSC24B09
  ref <308>: DATABASE ACCESSION NUMBER: NCBI ACCESSION: NZ_KV822194.1
  ref <309>: DATABASE ENTRY DATE: 2019-04-01
  ref <313>: RELEVANT RESIDUES IN SEQ ID NO: (1)..(1563)
ttttcatgagagtttgatcctggctcaggacgaacgctggcggcgtgcctaatacatgcaagtcgaacgaaccgcgactgagtgcttgcacttggtcaaggtgagtggcgaacgggtgagtaacacgtgggtaacctacctcatagtgggggataacagtcggaaacgactgctaataccgcataggacataggatcacatgatccagtgaggaaaggtggcgcaagctatcgctaagagatggacccgcggtgcattagctagttggtagggtaaaggcctaccaaggcgatgatgcatagccgacctgagagggtgatcggccacattgggactgagacacggcccaaactcctacgggaggcagcagtagggaatcttccgcaatggacgcaagtctgacggagcaacgccgcgtgagtgaagaaggtcttcggatcgtaaagctctgttgttagagaagaacagcgcatagagtaactgctatgcgtgtgacggtatctaaccagaaagccacggctaactacgtgccagcagccgcggtaatacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggaggggttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatcccgacgaccgctctagagatagagtttttcttcggaacgtcggtgacaggtggtgcatggttgtcgtcagctcgtgtcgtgagatgttgggttaagtcccgcaacgagcgcaacccctataactagttgccagcattcagatggggactctagttagactgccggtgacaaaccggaggaaggtggggatgacgtcaaatcatcatgccccttatgacctgggctacacacgtgctacaatggatggtacaacgagcagcgaactcgcgagggtaagcgaatctctaaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacccgaagccggtggcctaaccttttaggagggagccgtcgaaggtgggatagatgattggggtgaagtcgtaacaaggtagccgtatcggaaggtgcggctggatcacctcctttctaagga

SEQ ID NO: 902 - DNA, 1542 bp, Absiella dolichum
  ref <308>: DATABASE ACCESSION NUMBER: NCBI ACCESSION: NZ_QRPK01000093.1
  ref <309>: DATABASE ENTRY DATE: 2019-04-01
  ref <313>: RELEVANT RESIDUES IN SEQ ID NO: (1)..(1542)
caaatggagagtttgatcctggctcaggatgaacgctggcggcatgcctaatacatgcaagtcgaacgaagttttaggaaagcttgctttccaaaaagacttagtggcgaacgggtgagtaacacgtagataacctgcccatgtgcccgggataactgctggaaacggtagctaaaaccggataggtggcttcgaggcatctcggagacattaaaatggctacggccatgaacatggatggatctgcggcgcattagctagttggtgaggtaacggcccaccaaggcgacgatgcgtagccgacctgagagggtgaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagagaaaaacggatcatgtagggaatgacatgatagtgatggtatcttaccagaaagccacggctaactacgtgccagcagccgcggtaatacgtaggtggcaagcgttatccggaatgattgggcgtaaagggtgcgtaggtggtacattaagtctgaagtaaaaggcagcagctcaactgctgttcgctttggaaactggtgaactagagtgcaggagagggcgatggaattccatgtgtagcggtaaaatgcgtagatatatggaggaacaccagtggcgaaggcggtcgcctggcctgtaactgacactgaggcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcgcatgttaccaatattaagttagggactcatgtgagactgccggtgacaaaccggaggaaggtggggatgacgtcaaatcatcatgccccttatggcctgggctacacacgtactacaatggcgtctacaaagaggagcgacatggtgacatgaagcaaatctcataaagggcgtctcagttcggattggagtctgcaactcgactccatgaagtcggaatcgctagtaatcgcagatcagcatgctgcggtgaatacgttctcgggccttgtacacaccgcccgtcaaaccatgggagtcagtaatacccgaagccggtggcataacctaagggagtgagccgtcgaaggtaggaccgatgactggggttaagtcgtaacaaggtatccctacgggaacgtggggatggatcacctcctttcta

SEQ ID NO: 903 - DNA, 1542 bp, Absiella sp. AM09-45
  ref <308>: DATABASE ACCESSION NUMBER: NCBI ACCESSION: NZ_QVFJ01000002.1
  ref <309>: DATABASE ENTRY DATE: 2019-04-01
  ref <313>: RELEVANT RESIDUES IN SEQ ID NO: (1)..(1542)
caaatggagagtttgatcctggctcaggatgaacgctggcggcatgcctaatacatgcaagtcgaacgaagtctttagaaaagcttgcttttcaaaaagacttagtggcgaacgggtgagtaacacgtagggaacctgcccatgtgcctgggataacagatggaaacgtctgctaaaaccggataggtatgaggatcgcatgagcctcatattaaaagagcgctagctctgaacatggatggacctgcggcgcattagctagttggcggggtaacggcccaccaaggcaacgatgcgtagccgacctgagagggtgaacggccacattgggactgagacacggcccaaactcctacgggaggcagcagtagggaattttcgtcaatggagggaactctgaacgagcaatgccgcgtgagtgaagaaggtcttcggatcgtaaagctctgttgtaagagaaaaacggtggatataggaaatgatgtccaagtgatggtatcttaccagaaagccacggctaactacgtgccagcagccgcggtaatacgtaggtggcaagcgttatccggaatgattgggcgtaaagggtgcgtaggtggtgcattaagtctgaagtaaaagccagcagctcaactgctgtaagctttggaaactggtgtactagagtgcaggagagggcgatggaattccatgtgtagcggtaaaatgcgtagatatatggaggaacaccagtggcgaaggcggtcgcctggcctgtaactgacactgaggcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcgcatgttaccagcattcagttggggactcatgtgagactgccggtgacaaaccggaggaaggtggggatgacgtcaaatcatcatgccccttatggcctgggctacacacgtactacaatggcgtctacaaagaggagcgacacagtgatgtgaagcaaatctcataaaggacgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctcctttct

SEQ ID NO: 904 - DNA, 1542 bp, Absiella sp. AM09-50; identical to SEQ ID NO: 903
  ref <308>: DATABASE ACCESSION NUMBER: NCBI ACCESSION: NZ_QVFI01000004.1
  ref <309>: DATABASE ENTRY DATE: 2019-04-01
  ref <313>: RELEVANT RESIDUES IN SEQ ID NO: (1)..(1542)

SEQ ID NO: 905 - DNA, 1542 bp, Absiella sp. AM10-20
  ref <308>: DATABASE ACCESSION NUMBER: NCBI ACCESSION: NZ_QVFH01000002.1
  ref <309>: DATABASE ENTRY DATE: 2019-04-01
  ref <313>: RELEVANT RESIDUES IN SEQ ID NO: (1)..(1542)
caaatggagagtttgatcctggctcaggatgaacgctggcggcatgcctaatacatgcaagtcgaacgaagtctttagaaaagcttgcttttcaaaaagacttagtggcgaacgggtgagtaacacgtagggaacctgcccatgtgcctgggataacagatggaaacgtctgctaaaaccggataggtatgaggatcgcatgagcctcatattaaaagagcgctagctctgaacatggatggacctgcggcgcattagctagttggcggggtaacggcccaccaaggcaacgatgcgtagccgacctgagagggtgaacggccacattgggactgagacacggcccaaactcctacgggaggcagcagtagggaattttcgtcaatggagggaactctgaacgagcaatgccgcgtgagtgaagaaggtcttcggatcgtaaagctctgttgtaagagaaaaacgatggatataggaaatgatgtccaagtgatggtatcttaccagaaagccacggctaactacgtgccagcagccgcggtaatacgtaggtggcaagcgttatccggaatgattgggcgtaaagggtgcgtaggtggtgcattaagtctgaagtaaaagccagcagctcaactgctgtaagctttggaaactggtgtactagagtgcaggagagggcgatggaattccatgtgtagcggtaaaatgcgtagatatatggaggaacaccagtggcgaaggcggtcgcctggcctgtaactgacactgaggcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcgcatgttaccagcattcagttggggactcatgtgagactgccggtgacaaaccggaggaaggtggggatgacgtcaaatcatcatgccccttatggcctgggctacacacgtactacaatggcgtctacaaagaggagcgacacagtgatgtgaagcaaatctcataaaggacgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctcctttct

SEQ ID NO: 906 - DNA, 1542 bp, Absiella sp. AM22-9; identical to SEQ ID NO: 905
  ref <308>: DATABASE ACCESSION NUMBER: NCBI ACCESSION: NZ_QVFG01000005.1
  ref <309>: DATABASE ENTRY DATE: 2019-04-01
  ref <313>: RELEVANT RESIDUES IN SEQ ID NO: (1)..(1542)

SEQ ID NO: 907 - DNA, 1542 bp, Absiella sp. AM27-20; identical to SEQ ID NO: 903
  ref <308>: DATABASE ACCESSION NUMBER: NCBI ACCESSION: NZ_QUJU01000002.1
  ref <309>: DATABASE ENTRY DATE: 2019-04-01
  ref <313>: RELEVANT RESIDUES IN SEQ ID NO: (1)..(1542)

SEQ ID NO: 908 - DNA, 1542 bp, Absiella sp. AM29-15; identical to SEQ ID NO: 903
  ref <308>: DATABASE ACCESSION NUMBER: NCBI ACCESSION: NZ_QVFL01000009.1
  ref <309>: DATABASE ENTRY DATE: 2019-04-01
  ref <313>: RELEVANT RESIDUES IN SEQ ID NO: (1)..(1542)

SEQ ID NO: 909 - DNA, 1542 bp, Absiella sp. AM54-8XD; identical to SEQ ID NO: 903
  ref <308>: DATABASE ACCESSION NUMBER: NCBI ACCESSION: NZ_QVFK01000126.1
  ref <309>: DATABASE ENTRY DATE: 2019-04-01
  ref <313>: RELEVANT RESIDUES IN SEQ ID NO: (1)..(1542)

SEQ ID NO: 910 - DNA, 1541 bp, Abyssibacter profundi
  ref <308>: DATABASE ACCESSION NUMBER: NCBI ACCESSION: NZ_QEQK01000007.1
  ref <309>: DATABASE ENTRY DATE: 2019-04-01
  ref <313>: RELEVANT RESIDUES IN SEQ ID NO: (1)..(1541)
taattggagagtttgatcctggctcagattgaacgctggcggcaggcctaacacatgcaagtcgagcggtaacaggagaagcttgcttctcgctgacgagcggcggacgggtgagtaatgcgtaggaatctaccctttagtgggggatagcccggagaaatccggattaataccgcatgagctcttcggaggaaagtgggggatctttggacctcacgctgaaggatgagcctacgttggattagctagttggtggggtaaaggcctaccaaggcgacgatccatagctggtctgagaggatgatcagccacaccgggactgagacacggcccggactcctacgggaggcagcagtggggaatattggacaatgggcgaaagcctgatccagccatgccgcgtgtgtgaagaaggctctagggttgtaaagcactttaagcagggaagaaacgctgttggttaatacccatcagtactgacggtacctgcagaataagcaccggctaactccgtgccagcagccgcggtaatacggagggtgcaagcgttaatcggatttactgggcgtaaagcgtgcgtaggcggctacgtaagtcagttgtgaaagccccgggcttaacctgggaactgcaattgatactgcgtggctagaattcggtagaggaaggtggaactccaggtgtagcggtgaaatgcgtagatatctggaagaacatcaatggcgaaggcaaccttctgggcctgaattgacgctgaggtacgaaagcgtggggagcaaacaggattagataccctggtagtccacgctgtaaacgatgagaacttgatgttgggttgcttagcaattcagtatcggagctaacgcgttaagttctccgcctggggagtacggccgcaaggttgaaactcaaaggaattgacgggggcccgcacaagcggtggagcatgtggtttaattcgatgcaacgcgaagaaccttacctggccttgacatcctgcgaactttctagagatagattggtgccttcgggaacgcagtgacaggtgctgcatggctgtcgtcagctcgtgtcgtgagatgttgggttaagtcccgcaacgagcgcaacccttgtccttagttgccagcatttagttgggcactctaaggagaccgccggtgacaaaccggaggaaggtggggatgacgtcaagtcatcatggcccttatggccagggctacacacgtgctacaatggcaagtacagagggcagcgaagccgcgaggtgaagctaatcccacaaagcytgtcgtagtccggattgcagtctgcaactcgactgcatgaagtcggaatcgctagtaatcgcgaatcagcattgtcgcggtgaatacgttcccgggccttgtacacaccgcccgtcacaccatgggagttggttgcaccagaagtaggtagtctaaccttcgggaggacgcttaccacggtgtggtcaatgactggggtgaagtcgtaacaaggtagccgtaggggaacctgcggctggatcacctccttta

SEQ ID NO: 911 - DNA, 1555 bp, Abyssicoccus albus
  ref <308>: DATABASE ACCESSION NUMBER: NCBI ACCESSION: NZ_RKRK01000010.1
  ref <309>: DATABASE ENTRY DATE: 2019-04-01
  ref <313>: RELEVANT RESIDUES IN SEQ ID NO: (1)..(1555)
atttgagagtttgatcctggctcaggatgaacgctggcggcgtgcctaatacatgcaagtcgagcgcgtttcgaaggtgcttgcaccttcaatgaaacgagcggcggacgggtgagtaacacgtaggtaacctacctttatgactgggataaccacgggaaaccggggctaataccggataagatttagcttcgcatgaagcagaagtaaaaggcagtttcggctgtcacataaagatggacctgcggcgcattagctagttggagaggtaagagctccccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgttaaggaagaacaccatggataggaaatgatcgatggatgacggtacttaaccagaaagccacggctaactacgtgccagcagccgcggtaatacgtaggtggcaagcgttatccggaattattgggcgtaaagcgcgcgtaggcggtttcttaagtctgatgtgaaagcccccggctcaaccggggagggtcattggaaactggggaacttgagtacagaagaggagagtggaattccatgtgtagcggtgaaatgcgcagagatatggaggaacaccagtggcgaaggcggctctctggtctgaaactgacgctgaggtgcgaaagcgtggggatcaaacaggattagataccctggtagtccacgctgtaaacgatgagtgctaagtgttagggggtttccgccccttagtgctgcagtaaacgcattaagcactccgcctggggagtacggccgcaaggttgaaactcaaaggaattgacggggacctgcacaagcggtggagcatgtggtttaattcgaagcaacgcgaagaaccttaccaaatcttgacatcctctgacaactttagagataaagtgtcccttcggggcagagagacaggtggtgcatggttgtcgtcagctcgtgtcgtgagatgttgggttaagtcccgcaacgagcgcaacccttaacattagttgccatcattgagttgggcactctaatgtgactgccggtgacaaaccggaggaaggtggggatgacgtcaaatcatcatgccccttatgatttgggctacacacgtgctacaatggataggaacaaagggtggcgaagtcgtgagatgaagcaaatcccataaaactattcccagttcggattgtagtctgcaactcgactacatgaaggtggaatcgctagtaatcgtggatcagcatgccacggtgaatacgttcccaggtcttgtacacaccgcccgtcacaccacgagagttcgtaacacccgaagccggtgggctaacattgaggcagccgtcgaaggtgggacgaatgattggggtgaagtcgtaacaaggtagccgtatcggaaggtgcggctggatcacctcctttctaaggaa

SEQ ID NO: 912 - DNA, 1503 bp, Acaryochloris marina
  ref <308>: DATABASE ACCESSION NUMBER: NCBI ACCESSION: NC_009925.1
  ref <309>: DATABASE ENTRY DATE: 2019-04-01
  ref <313>: RELEVANT RESIDUES IN SEQ ID NO: (1)..(1503)
acatggagagtttgatcctggctcaggatgaacgctggcggtatgcttaacacatgcaagtcgaacggcagcacgaggagcttgctccttggtggcgagtggcggacgggtgagtaacgcgtgagaatctaccttcaggtctgggacaacagttggaaacgactgctaataccggatgtgccttagggtgaaagttttttcgcctgaagatgagctcgcgtctgattagttagttggtggggtaaaggcttaccaagacatcgatcagtagctggtctgagaggacgatcagccacactgggactgagacacggcccagactcctacgggaggcagcagtggggaattttccgcaatgggcgaaagcctgacggagcaataccgcgtgcgggaggaaggcctttgggtcgtaaaccgcttttaacagggaagaagatctgacggtacctgttgaataagcctcggctaactccgtgccagcagccgcggtaagacggaggaggcaagcgttatccggaattattgggcgtaaagcgtccgcaggtggcctatcaagtctgttgttaaagcccagggctcaactctggatcagcaatggaaactgaaaggctagagtacggtaggggtagagggaattcccagtgtagcggtgaaatgcgtagatattgggaagaacaccagtggcgaaggcgctctgctgggccgtaactgacactcatggacgaaagctaggggagcgaaagggattagatacccctgtagtcctagctgtaaacgatgaacactaggtgttggccgtatcgacccggtcagtgccgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggcttgacatgtcgcgaatccgagtgaaagcttggagtgccttcgggaacgcgaacacaggtggtgcatggctgtcgtcagctcgtgtcgtgagatgttgggttaagtcccgcaacgagcgcaacccacgtttttagttgccatcattcagttgggcactctagaaagactgccggtgacaaaccggaggaaggtgtggatgacgtcaagtcagcatgccccttacgctctgggctacacacgtactacaatggttaggacaaagagctgccaactcgcgagagtgcgctaatctcataaacctagcctcagttcagattgcaggctgcaactcgcctgcatgaaggaggaatcgctagtaatcgcaggtcagcatactgcggtgaatacgttcccgggccttgtacacaccgcccgtcacaccatggaagctggccacgcccgaagtcgttaccccaacccttgtggagggggacgccgaaggtagggctggtgactggggtgaagtcgtaacaaggtagccgtaccggaaggtgtggctggatcacctcctttt

SEQ ID NO: 913 - DNA, 1502 bp, Acaryochloris sp. CCMEE 5410
  ref <308>: DATABASE ACCESSION NUMBER: NCBI ACCESSION: NZ_AFEJ01000262.1
  ref <309>: DATABASE ENTRY DATE: 2019-04-01
  ref <313>: RELEVANT RESIDUES IN SEQ ID NO: (1)..(1502)
catggagagtttgatcctggctcaggatgaacgctggcggtatgcttaacacatgcaagtcgaacggcagcacgaggagcttgctccttggtggcgagtggcggacgggtgagtaacgcgtgagaatctaccttcaggtctgggacaacagttggaaacgactgctaataccggatgtgccttagggtgaaagttttttcgcctgaagatgagctcgcgtctgattagttagttggtggggtaacggcttaccaagacatcgatcagtagctggtctgagaggacgatcagccacactgggactgagacacggcccagactcctacgggaggcagcagtggggaattttccgcaatgggcgaaagcctgacggagcaataccgcgtgcgggaggaaggcctttgggtcgtaaaccgcttttaacagggaagaagatctgacggtacctgttgaataagcctcggctaactccgtgccagcagccgcggtaagacggaggaggcaagcgttatccggaattattgggcgtaaagcgtccgcaggtggcctatcaagtctgttgttaaagcccagggctcaactctggatcagcaatggaaactgaaaggctagagtacggtaggggtagagggaattcccagtgtagcggtgaaatgcgtagatattgggaagaacaccagtggcgaaggcgctctgctgggccgtaactgacactcatggacgaaagctaggggagcgaaagggattagatacccctgtagtcctagctgtaaacgatgaacactaggtgttggccgtatcgacccggtcagtgccgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggcttgacatgtcgcgaatccttgggaaaccaaggagtgccttcgggaacgcgaacacaggtggtgcatggctgtcgtcagctcgtgtcgtgagatgttgggttaagtcccgcaacgagcgcaacccacgtctttagttgccatcatttagttgggcactctagagagactgccggtgacaaaccggaggaaggtgtggatgacgtcaagtcagcatgccccttacgctctgggctacacacgtactacaatggttaggacaaagagctgccaactcgcgagagtgcgctaatctcataaacctagcctcagttcagattgcaggctgcaactcgcctgcatgaaggaggaatcgctagtaatcgcaggtcagcatactgcggtgaatacgttcccgggccttgtacacaccgcccgtcacaccatggaagctggccacgcccgaagtcgttaccccaacccttgtggagggggacgccgaaggtagggctggtgactggggtgaagtcgtaacaaggtagccgtaccggaaggtgtggctggatcacctcctttt

SEQ ID NO: 914 - DNA, 1509 bp, Acaryochloris sp. RCC1774
  ref <308>: DATABASE ACCESSION NUMBER: NCBI ACCESSION: NZ_PQWO01000056.1
  ref <309>: DATABASE ENTRY DATE: 2019-04-01
  ref <313>: RELEVANT RESIDUES IN SEQ ID NO: (1)..(1509)
caacatggagagtttgatcctggctcaggatgaacgctggcggtatgcttaacacatgcaagtcgaacggcagcacgaggagcttgctccttggtggcgagtggcggacgggtgagtaacgcgtgaggatctgcccttaggcgggggacaacagttggaaacgactgctaataccccatatgccgagaggtgaaagatttattacctgaggatgacctcgcgtctgattagctagttggtgaggtaacggctcaccaaggcgacgatcagtagctggtctgagaggacgatcagccacactggaactgagacacggtccagactcctacgggaggcagcagtggggaattttccgcaatgggcgcaagcctgacggagcaataccgcgtgcgggaggaaggcccttgggtcgtaaaccgcttttaacagggaagaataactgacggtacctgttgaataagcctcggctaactccgtgccagcagccgcggtaatacggaggaggcaagcgttatccggaattattgggcgtaaagcgtccgcaggtggcccagcaagtctgctgttaaatcccagggctcaaccctggagcggcggtggaaactgttgagctagagtgcggtaggggcagagggaattcccagtgtagcggtgaaatgcgtagatattgggaagaacaccagtggcgaaggcgctctgctggaccgcaactgacactcatggacgaaagctaggggagcgaaagggattagatacccctgtagtcctagccgtaaacgatgaacactaggtgttggacgtatcgacccgttcagtgccgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggcttgacatgtcgcgaatctttgtgaaagcagagagtgccttcgggagcgcgaacacaggtggtgcatggctgtcgtcagctcgtgtcgtgagatgttgggttaagtcccgcaacgagcgcaacccacgtatttagttgccatcattaagttgggcactctagatagactgccggtgacaaaccggaggaaggtgtggatgacgtcaagtcagcatgccccttacgtcctgggctacacacgtactacaatggttgggacaaagggttgcaaactcgcgagagctagctaatcccataaacccagcctcagttcagattgcaggctgcaactcgcctgcatgaagtaggaatcgctagtaatcgcaggtcagcatactgcggtgaatacgttcccgggccttgtacacaccgcccgtcacaccatggaagttggccacgcccgaagtcgttactccaaccgcttgcggagggggacgccgaaggtagggctgatgactggggtgaagtcgtaacaaggtagccgtaccggaaggtgtggctggatcacctcctttcagg

SEQ ID NO: 915 - DNA, 1312 bp, Acetatifactor muris
  ref <308>: DATABASE ACCESSION NUMBER: NCBI ACCESSION: NZ_OFSM01000127.1
  ref <309>: DATABASE ENTRY DATE: 2019-04-01
  ref <313>: RELEVANT RESIDUES IN SEQ ID NO: (1)..(1312)
ctccggtggtatgggatggacccgcgtccgattagccagttggcggggtagaggcccaccaaagcgacgatcggtagccggcctgagagggcggacggccacattgggactgagacacggcccaaactcctacgggaggcagcagtggggaatattgcacaatggggggaaccctgatgcagcgacgccgcgtgagtgaagaagtcattcgtgatgtaaagctctatcagcagggaagaaaatgacggtacctgactaagaagccccggctaactacgtgccagcagccgcggtaatacgtagggggcaagcgttatccggatttactgggtgtaaagggagcgtagacggcagcgcaagtccgaagtgaaagcccggggcccaaccccgggactgctttggaaactgtgaagctggagtgcgggaggggcaggcggaattcctggtgtagcggtgaaatgcgtagatatcaggaggaacaccggcggcgaaggcggcctgctggaccgtaactgacgttgaggctcgaaagcgtggggagcaaacaggattagataccctggtagtccacgcggtaaacgatgattactaggtgtcggggggcagagcccttcggtgccgccgcaaacgcagtaagtaatccacctggggagtacgttcgcaagaatgaaactcaaaggaattgacggggacccgcacaagcggtggagcatgtggtttaattcgatgcaacgcgaagaaccttacccggccttgacatccttccgaatactgagtaatgtcagtagaccttcgggacgggagagacaggtggtgcatggttgtcgtcagctcgtgtcgtgagatgttgggttaagtcccgcaacgagcgcaacccctacagccagtagccagcaggtaaagctgggcactctggcgggacagcctgggataaccaggaggaaggcggggacgacgtcaaatcatcatgccccttatggccggggctacacacgtgctacaatggcgtaaacagagggaagcgagatagcgatattaagcgaagcccaaaaataacgcctcagttcggattgcagcctgcaactcggctgcatgaagccggaatcgctagtaatcgcggatcagaatgccgcggtgaatacgttcccgggtcttgtacacaccgcccgtcacaccatgggagtcgggaatgcccgaagtcggtgagctaacgaaagaggcagccgccgaaggcaggcctggtaactggggtgaagtcgtaacaaggtagccgtatcggaaggtgcggctggatcacctcctttctaaggaa

SEQ ID NO: 916 - DNA, 485 bp, Acetoanaerobium noterae
  ref <308>: DATABASE ACCESSION NUMBER: NCBI ACCESSION: NZ_FUYN01000003.1
  ref <309>: DATABASE ENTRY DATE: 2019-04-01
  ref <313>: RELEVANT RESIDUES IN SEQ ID NO: (1)..(485)
ttatatttgagagtttgatcctggctcaggatgaacgctggcggcgtgcttaacacatgcaagtcgagcgggcaatttatctagcactgattacttcaaatggctatcgccagtgtaatcatgagtttctacctttaataaggaaaaaaaagaaattcatgtacgcaaatagtgataatacattttagtggagtgatgagtgctggataaattgctagcggcggacgggtgcgtaacacgtgggtaacctgcccctatcactgggataacacactgaaaagtgtgctaataccagataacataagcttttggcatcattagcttatcaaagaatttcggatagggatgggcccgcgtctgattagctagttggtgaggtaacggctcaccaaggcaacgatcagtagccgacctgagagggtgatcggccacactggaactgagacacggtccagactcctacgggaggcagcagtggggaatat

SEQ ID NO: 917 - DNA, 1641 bp, Acetoanaerobium sticklandii
  ref <308>: DATABASE ACCESSION NUMBER: NCBI ACCESSION: NC_014614.1
  ref <309>: DATABASE ENTRY DATE: 2019-04-01
  ref <313>: RELEVANT RESIDUES IN SEQ ID NO: (1)..(1641)
ttatatttgagagtttgatcctggctcaggatgaacgctggcggcgtgcttaacacatgcaagtcgagcgggcaatttatctagcactgattacttcaaatgaaaatcataagtgtaatcatgaatttctaccttataataaagaaaaaagaaattcatgtacgcaaatagtgataacacatgaaagtggagtgatgagtgctggataaattgctagcggcggacgggtgcgtaacacgtgggtaacctgcccctatcactgggataacacactgaaaagtgtgctaataccagataatataagcttttggcatcattagcttatcaaagaatttcggatagggatgggcccgcgtctgattagctagttggtgaagtaacggctcaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctatgggaagataatgacggtaccataggaggaagccccggctaactacgtgccagcagccgcggtaatacgtagggggcaagcgttatccggaattactgggcgtaaagggtgcgtaggcggtttatcaagtcaggggtgaaaggctacggctcaaccgtagtgagcctctgaaactggtgaacttgagtgtaggagaggaaagtggaattcccagtgtagcggtgaaatgcgtagatattgggaggaacaccagtggcgaaggcgactttctggactacaactgacgctgaggcacgaaagcgtggggagcaaacaggattagataccctggtagtccacgctgtaaacgatgagtactaggtgtcggctgtcaaaggtcggtgccggcgttaacacattaagtactccgcctggggagtacgctcgcaagagtgaaactcaaaggaattgacggggacccgcacaagtagcggagcatgtggtttaattcgaagcaacgcgaagaaccttacctaggcttgacatccctttgcaaagcccttaaccgggctcctcttgttcgcaagacaaaggtgacaggtggtgcatggttgtcgtcagctcgtgtcgtgagatgttgggttaagtcccgcaacgagcgcaacccctatttttagttgccatcagttcggctgggcactctagaaagactgccgaggacaactcggaggaaggtggggatgacgtcaaatcatcatgccccttatgcttagggctacacacgtgctacaatggctgttacaaagggctgcgagaccgcgaggtggagccaatcccagaaaaacagtctaagttcggattgtaggctgaaactcgcctacatgaagccggagttactagtaatcgcagatcagaatgctgcggtgaatgcgttcccgggtcttgtacacaccgcccgtcacaccatggaagttgggggcacccaaagttagttatccaaccttacggaggaggctacctaaggtgaattcaatgactggggtgaagtcgtaacaaggtagccgtatcggaaggtgcggctggatcacctcctttctaggga

SEQ ID NO: 918 - DNA, 1494 bp, Acetobacter aceti
  ref <308>: DATABASE ACCESSION NUMBER: NCBI ACCESSION: NZ_BEWK01000105.1
  ref <309>: DATABASE ENTRY DATE: 2019-04-01
  ref <313>: RELEVANT RESIDUES IN SEQ ID NO: (1)..(1494)
atgaacctgagagtttgatcctggctcagagcgaacgctggcggcatgcttaacacatgcaagtcgcacgaaggcttcggccttagtggcggacgggtgagtaacgcgtaggaatctatccatgggtgggggataactccgggaaactggagctaataccgcatgatacctgagggtcaaaggcgcaagtcgcctgtggaggagcctgcgtttgattagcttgttggtggggtaaaggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtatgagagagggttgtggaattctcagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatggagaggctgtattcagagatggatatttcccgcaagggacctcttgcacaggtgctgcatggctgtcgtcagctcgtgtcgtgagatgttgggttaagtcccgcaacgagcgcaacccttatctttagttgccagcatgtttgggtgggcactctaaagagactgccggtgacaagccggaggaaggtggggatgacgtcaagtcctcatggcccttatgtcctgggctacacacgtgctacaatggcggtgacagtgggaagctagatggcgacatcgtgccgatctctaaaaaccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 919 - DNA, 1501 bp, Acetobacter ascendens
  ref <308>: DATABASE ACCESSION NUMBER: NCBI ACCESSION: NZ_CP021524.1
  ref <309>: DATABASE ENTRY DATE: 2019-04-01
  ref <313>: RELEVANT RESIDUES IN SEQ ID NO: (1)..(1501)
atgaacctgagagtttgatcctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcgagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgacttagtcattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgcaagcagagatgtttgtttcccgcaagggacctctaacacaggtgctgcatggctgtcgtcagctcgtgtcgtgagatgttgggttaagtcccgcaacgagcgcaacccctatctttagttgccatcaggttgggctgggcactctagagagactgccggtgacaagccggaggaaggtggggatgacgtcaagtcctcatggcccttatgtcctgggctacacacgtgctacaatggcggtgacagtgggaagctaggtggtgacaccatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaaggaactgt

SEQ ID NO: 920 - DNA, 1496 bp, Acetobacter cerevisiae
  ref <308>: DATABASE ACCESSION NUMBER: NCBI ACCESSION: NZ_LIAA01000028.1
  ref <309>: DATABASE ENTRY DATE: 2019-04-01
  ref <313>: RELEVANT RESIDUES IN SEQ ID NO: (1)..(1496)
atgaacctgagagtttgatcctggctcagagcgaacgctggcggcatgcttaacacatgcaagtcgcacgaaggtttcggccttagtggcggacgggtgagtaacgcgtaggaatctatccatgggtgggggataactccgggaaactggagctaataccgcatgatacctgagggtcaaaggcgcaagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagttagatgtgaaatccccgggcttaacctgggagctgcatttaatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtgtccagagatgggcatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcgatgacaatgggaagctagatggcgacatcgtgctgatctcaaaaagtcgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaag

SEQ ID NO: 921 - DNA, 1503 bp, Acetobacter cibinongensis
  ref <308>: DATABASE ACCESSION NUMBER: NCBI ACCESSION: NZ_JOMQ01000101.1
  ref <309>: DATABASE ENTRY DATE: 2019-04-01
  ref <313>: RELEVANT RESIDUES IN SEQ ID NO: (1)..(1503)
atgaacctgagagtttgatcctggctcagagcgaacgctggcggcatgcttaacacatgcaagtcgcacgaaggtttcggccttagtggcggacgggtgagtaacgcgtaggaatctatccatgggtgggggataactctgggaaactggagctaataccgcatgacaccttagggtcaaaggcgcaagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctagatgttgggtaacttagttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtatccagagatggatatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgccctgggctacacacgtgctacaatggcggtgacagtgggaagctagatggcgacatcgtgctgatctctaaaaaccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaaggaactgt

SEQ ID NO: 922 - DNA, 1503 bp, Acetobacter fabarum
  ref <308>: DATABASE ACCESSION NUMBER: NCBI ACCESSION: NZ_PDEU01000040.1
  ref <309>: DATABASE ENTRY DATE: 2019-04-01
  ref <313>: RELEVANT RESIDUES IN SEQ ID NO: (1)..(1503)
atgaacctgagagtttgatcctggctcagagcgaacgctggcggcatgcttaacacatgcaagtcgcacgaacctttcggggttagtggcggacgggtgagtaacgcgtaggaatctgtccacgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttacacagtcagatgtgaaatccccgggcttaacctgggagctgcatttgatacgtgtagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtaactttgttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggtgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaaggaactgt

SEQ ID NO: 923 - DNA, 1503 bp, Acetobacter ghanensis
  ref <308>: DATABASE ACCESSION NUMBER: NCBI ACCESSION: NZ_LN609302.1
  ref <309>: DATABASE ENTRY DATE: 2019-04-01
  ref <313>: RELEVANT RESIDUES IN SEQ ID NO: (1)..(1503)
atgaacctgagagtttgatcctggctcagagcgaacgctggcggcatgcttaacacatgcaagtcgcacgaacctttcggggttagtggcggacgggtgagtaacgcgtaggaatctgtccatgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtaactttgttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcacgtttgggtgggcactctagagagactgccggtgacaagccggaggaaggtggggatgacgtcaagtcctcatggcccttatgtcctgggctacacacgtgctacaatggcggtgacagtgggaagctagatggtgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaaggaactgt

SEQ ID NO: 924 - DNA, 1503 bp, Acetobacter indonesiensis
  ref <308>: DATABASE ACCESSION NUMBER: NCBI ACCESSION: NZ_JOPA01000029.1
  ref <309>: DATABASE ENTRY DATE: 2019-04-01
  ref <313>: RELEVANT RESIDUES IN SEQ ID NO: (1)..(1503)
atgaacctgagagtttgatcctggctcagagcgaacgctggcggcatgcttaacacatgcaagtcgcacgaaggtttcggccttagtggcggacgggtgagtaacgcgtaggaatctatccgtgggtgggggataactctgggaaactggagctaataccgcatgacacctgagggtcaaaggcgcaagtcgcctgcggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgagacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttattcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtattcagagatggatatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggcgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaaggaactgt

SEQ ID NO: 925 - DNA, 1496 bp, Acetobacter malorum
  ref <308>: DATABASE ACCESSION NUMBER: NCBI ACCESSION: NZ_JOPG01000004.1
  ref <309>: DATABASE ENTRY DATE: 2019-04-01
  ref <313>: RELEVANT RESIDUES IN SEQ ID NO: (1)..(1496)
atgaacctgagagtttgatcctggctcagagcgaacgctggcggcatgcttaacacatgcaagtcgcacgaaggcttcggccttagtggcggacgggtgagtaacgcgtaggaatctatccatgggtgggggataactccgggaaactggagctaataccgcatgatacctgagggtcaaaggcgcaagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagttagatgtgaaatccccgggcttaacctgggagctgcatttaatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtgtccagagatgggcatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcgatgacaatgggaagctagatggcgacatcgtgctgatctcaaaaagtcgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaag

SEQ ID NO: 926 - DNA, 1503 bp, Acetobacter nitrogenifigens
  ref <308>: DATABASE ACCESSION NUMBER: NCBI ACCESSION: NZ_AUBI01000042.1
  ref <309>: DATABASE ENTRY DATE: 2019-04-01
  ref <313>: RELEVANT RESIDUES IN SEQ ID NO: (1)..(1503)
atgaacctgagagtttgatcctggctcagagcgaacgctggcggcatgcttaacacatgcaagtcgcacggaggttttcggacttcagtggcggacgggtgagtaacgcgtagggatctatccacgggtgggggataactccgggaaactggagctaataccgcatgacacctgagggtcaaaggcgcaagtcgcctgtggaggagcctgcgttcgattagcttgttggtggggtaaaggcctaccaaggcgatgatcgatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttggacagtcagatgtgaaatccccgggcttaacctgggagctgcatttgatacgtccagactagagtgtgagagagggttgtggaattctcagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatggagaggctgtattcagagatggatatttcccgcaagggacctcttgcacaggtgctgcatggctgtcgtcagctcgtgtcgtgagatgttgggttaagtcccgcaacgagcgcaacccttatctttagttgccagcatgtttgggtgggcactctaaagagactgccggtgacaagccggaggaaggtggggatgacgtcaagtcctcatggcccttatgtcctgggctacacacgtgctacaatggcggtgacagtgggaagctagatggcgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaaggaactgt

SEQ ID NO: 927 - DNA, 1503 bp, Acetobacter okinawensis
  ref <308>: DATABASE ACCESSION NUMBER: NCBI ACCESSION: NZ_JOPJ01000057.1
  ref <309>: DATABASE ENTRY DATE: 2019-04-01
  ref <313>: RELEVANT RESIDUES IN SEQ ID NO: (1)..(1503)
atgaacctgagagtttgatcctggctcagagcgaacgctggcggcatgcttaacacatgcaagtcgcacgaacctttcggggttagtggcggacgggtgagtaacgcgtaggaatctgtccacgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgagacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgactttgtcattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggtgacatcatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaaggaactgt

SEQ ID NO: 928 - DNA, 1502 bp, Acetobacter orientalis
  ref <308>: DATABASE ACCESSION NUMBER: NCBI ACCESSION: NZ_AP018515.1
  ref <309>: DATABASE ENTRY DATE: 2019-04-01
  ref <313>: RELEVANT RESIDUES IN SEQ ID NO: (1)..(1502)
atgaacctgagagtttgatcctggctcagagcgaacgctggcggcatgcttaacacatgcaagtcgcacgaaggtttcggccttagtggcggacgggtgagtaacgcgtaggaatctatccatgggtgggggataactctgggaaactggagctaataccgcatgatacctgagggtcaaaggcgcgagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctagatgttgggtaacttagttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtgtccagagatgggcatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggcgacatcgtgctgatctctaaaaaccgtctcagttcggattgtactctgcaactcgagtacatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaaggaactg

SEQ ID NO: 929 - DNA, 1496 bp, Acetobacter orleanensis
  ref <308>: DATABASE ACCESSION NUMBER: NCBI ACCESSION: NZ_NWTP01000033.1
  ref <309>: DATABASE ENTRY DATE: 2019-04-01
  ref <313>: RELEVANT RESIDUES IN SEQ ID NO: (1)..(1496)
atgaacctgagagtttgatcctggctcagagcgaacgctggcggcatgcttaacacatgcaagtcgcacgaaggtttcggccttagtggcggacgggtgagtaacgcgtaggaatctatccacgggtgggggataactccgggaaactggagctaataccgcatgatacctgagggtcaaaggcgcaagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagttagatgtgaaatccccgggcttaacctgggagctgcatttaagacgtatagactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtgtccagagatgggcatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcgatgacaatgggaagctagatggcgacatcgtgctgatctcaaaaagtcgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaag

SEQ ID NO: 930 - DNA, 1501 bp, Acetobacter oryzifermentans
  ref <308>: DATABASE ACCESSION NUMBER: NCBI ACCESSION: NZ_CP022374.1
  ref <309>: DATABASE ENTRY DATE: 2019-04-01
  ref <313>: RELEVANT RESIDUES IN SEQ ID NO: (1)..(1501)
atgaacctgagagtttgatcctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgtaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgacttagtcattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgcaagcagagatgtttgtttcccgcaagggacctctaacacaggtgctgcatggctgtcgtcagctcgtgtcgtgagatgttgggttaagtcccgcaacgagcgcaacccctatctttagttgccatcaggttgggctgggcactctagagagactgccggtgacaagccggaggaaggtggggatgacgtcaagtcctcatggcccttatgtcctgggctacacacgtgctacaatggcggtgacagtgggaagctaggtggtgacaccatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaaggaactgt

SEQ ID NO: 931 - DNA, 1501 bp, Acetobacter pasteurianus
  ref <308>: DATABASE ACCESSION NUMBER: NCBI ACCESSION: NZ_BDEZ01000073.1
  ref <309>: DATABASE ENTRY DATE: 2019-04-01
  ref <313>: RELEVANT RESIDUES IN SEQ ID NO: (1)..(1501)
atgaacctgagagtttgatcctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcgagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagctccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgacttagtcattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgcaagcagagatgtttgtttcccgcaagggacctctaacacaggtgctgcatggctgtcgtcagctcgtgtcgtgagatgttgggttaagtcccgcaacgagcgcaacccctatctttagttgccatcaggttgggctgggcactctagagagactgccggtgacaagccggaggaaggtggggatgacgtcaagtcctcatggcccttatgtcctgggctacacacgtgctacaatggcggtgacagtgggaagctaggtggtgacaccatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaaggaactgt

SEQ ID NO: 932 - DNA, 1496 bp, Acetobacter persici
  ref <308>: DATABASE ACCESSION NUMBER: NCBI ACCESSION: NZ_JOPC01000065.1
  ref <309>: DATABASE ENTRY DATE: 2019-04-01
  ref <313>: RELEVANT RESIDUES IN SEQ ID NO: (1)..(1496)
atgaacctgagagtttgatcctggctcagagcgaacgctggcggcatgcttaacacatgcaagtcgcacgaaggtttcggccttagtggcggacgggtgagtaacgcgtaggaatctatccatgggtgggggataactccgggaaactggagctaataccgcatgatacctgagggtcaaaggcgcaagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgcacagttagatgtgaaatccccgggcttaacctgggagctgcatttaatacgtgcagactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtattcagagatggatatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcgatgacaatgggaagctagatggcgacatcgtgctgatctcaaaaagtcgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaag

SEQ ID NO: 933 - DNA, 1501 bp, Acetobacter pomorum
  ref <308>: DATABASE ACCESSION NUMBER: NCBI ACCESSION: NZ_CP023189.1
  ref <309>: DATABASE ENTRY DATE: 2019-04-01
  ref <313>: RELEVANT RESIDUES IN SEQ ID NO: (1)..(1501)
atgaacctgagagtttgatcctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgtaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgacttagtcattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgcaagcagagatgtttgtttcccgcaagggatctctaacacaggtgctgcatggctgtcgtcagctcgtgtcgtgagatgttgggttaagtcccgcaacgagcgcaacccctatctttagttgccatcaggttgggctgggcactctagagagactgccggtgacaagccggaggaaggtggggatgacgtcaagtcctcatggcccttatgtcctgggctacacacgtgctacaatggcggtgacagtgggaagctaggtggtgacaccatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaaggaactgt

SEQ ID NO: 934 - DNA, 1505 bp, Acetobacter senegalensis
  ref <308>: DATABASE ACCESSION NUMBER: NCBI ACCESSION: NZ_JOOZ01000103.1
  ref <309>: DATABASE ENTRY DATE: 2019-04-01
  ref <313>: RELEVANT RESIDUES IN SEQ ID NO: (1)..(1505)
atgaacctgagagtttgatcctggctcagagcgaacgctggcggcatgcttaacacatgcaagtcgcacgaaggtttcggccttagtggcggacgggtgagtaacgcgtaggaatctatccatgggtgggggataactctgggaaactggagctaataccgcatgatacctgagggtcaaaggcgcgagtcgcctgtggaggagcctgcgttcgattagcttgttggtggggtaatggcctaccaaggcgatgatcgatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggcaacttagttgttcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgtgtaggctgtgtccagagatgggcatttcccgcaagggacctacagcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggcgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccagcaatggggcgcagccgaccacggtcgggtcagcgactggggtgaagtcgtaacaaggtagccgtaggggaacctgcggctggatcacctcctttcaaggaactgt

SEQ ID NO: 935 - DNA, 1501 bp, Acetobacter sp. B6
  ref <308>: DATABASE ACCESSION NUMBER: NCBI ACCESSION: NZ_SATT01000001.1
  ref <309>: DATABASE ENTRY DATE: 2019-04-01
  ref <313>: RELEVANT RESIDUES IN SEQ ID NO: (1)..(1501)
atgaacctgagagtttgatcctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgacttagtcattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgcaagcagagatgtttgtttcccgcaagggacctctaacacaggtgctgcatggctgtcgtcagctcgtgtcgtgagatgttgggttaagtcccgcaacgagcgcaacccctatctttagttgccatcaggttgggctgggcactctagagagactgccggtgacaagccggaggaaggtggggatgacgtcaagtcctcatggcccttatgtcctgggctacacacgtgctacaatggcggtgacagtgggaagctaggtggtgacaccatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaaggaactgt

SEQ ID NO: 936 - DNA, 1501 bp, Acetobacter sp. BCRC 14118; identical to SEQ ID NO: 931
  ref <308>: DATABASE ACCESSION NUMBER: NCBI ACCESSION: NZ_MAPU01000066.1
  ref <309>: DATABASE ENTRY DATE: 2019-04-01
  ref <313>: RELEVANT RESIDUES IN SEQ ID NO: (1)..(1501)

SEQ ID NO: 937 - DNA, 1501 bp, Acetobacter sp. DmW 043
  ref <308>: DATABASE ACCESSION NUMBER: NCBI ACCESSION: NZ_JOMN01000077.1
  ref <309>: DATABASE ENTRY DATE: 2019-04-01
  ref <313>: RELEVANT RESIDUES IN SEQ ID NO: (1)..(1501)
atgaacctgagagtttgatcctggctcagagcgaacgctggcggcatgcttaacacatgcaagtcgcacgaaggtttcggccttagtggcggacgggtgagtaacgcgtaggaatctatccacgggtgggggataacttcgggaaactgaagctaataccgcatgatacctgagggtcaaaggcgcaagtcgcctgtggaggagcctgcgtttgattagcttgttggtggggtaatggcctaccaaggcgatgatcgatagctggtttgagaggatgatcagccacactgggactgagacacggcccagactcctgcgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgccagatgttgggtaacttagttattcagtgtcgtagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgggcaggccgtatccagagatggatatttcccgcaagggacctgccacacaggtgctgcatggctgtcgtcagctcgtgtcgtgagatgttgggttaagtcccgcaacgagcgcaacccttatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggcgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgatcacggtcgggtcagcgactggggtgaagtcgtaacaaggtagccgtaggggaacctgcggctggatcacctcctttcaaggaactgt

SEQ ID NO: 938 - DNA, 1501 bp, Acetobacter sp. DsW 059
  ref <308>: DATABASE ACCESSION NUMBER: NCBI ACCESSION: NZ_JOPI01000004.1
  ref <309>: DATABASE ENTRY DATE: 2019-04-01
  ref <313>: RELEVANT RESIDUES IN SEQ ID NO: (1)..(1501)
atgaacctgagagtttgatcctggctcagagcgaacgctggcggcatgcttaacacatgcaagtcgcacgaaggtttcggccttagtggcggacgggtgagtaacgcgtaggaatctatccacgggtgggggataacttcgggaaactgaagctaataccgcatgatacctgagggtcaaaggcgcaagtcgcctgtggaggagcctgcgtttgattagcttgttggtggggtaatggcctaccaaggcgatgatcgatagctggtttgagaggatgatcagccacactgggactgagacacggcccagactcctgcgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcaaactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgccagatgttgggtaacttagttattcagtgtcgtagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgggcaggccgtatccagagatggatatttcccgcaagggacctgccacacaggtgctgcatggctgtcgtcagctcgtgtcgtgagatgttgggttaagtcccgcaacgagcgcaacccttatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggcgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgatcacggtcgggtcagcgactggggtgaagtcgtaacaaggtagccgtaggggaacctgcggctggatcacctcctttcaaggaactgt

SEQ ID NO: 939 - DNA, 1503 bp, Acetobacter sp. DsW 063
  ref <308>: DATABASE ACCESSION NUMBER: NCBI ACCESSION: NZ_JOPL01000043.1
  ref <309>: DATABASE ENTRY DATE: 2019-04-01
  ref <313>: RELEVANT RESIDUES IN SEQ ID NO: (1)..(1503)
atgaacctgagagtttgatcctggctcagagcgaacgctggcggcatgcttaacacatgcaagtcgcacggaggttttcggacttcagtggcggacgggtgagtaacgcgtagggatctatccacgggtgggggataactccgggaaactggagctaataccgcatgatacctgagggtcaaaggcgcaagtcgcctgtggaggagcctgcgttcgattagcttgttggtggggtaaaggcctaccaaggcgatgatcgatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttggacagtcagatgtgaaatccccgggcttaacctgggagctgcatttgatacgtccagactagagtgtgagagagggttgtggaattctcagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatggagaggctgtattcagagatggatatttcccgcaagggacctcttgcacaggtgctgcatggctgtcgtcagctcgtgtcgtgagatgttgggttaagtcccgcaacgagcgcaacccttatctttagttgccagcatgtttgggtgggcactctaaagagactgccggtgacaagccggaggaaggtggggatgacgtcaagtcctcatggcccttatgtcctgggctacacacgtgctacaatggcggtgacagtgggaagctagatggcgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaaggaactgt

SEQ ID NO: 940 - DNA, 1503 bp, Acetobacter sp. DsW 54; identical to SEQ ID NO: 922
  ref <308>: DATABASE ACCESSION NUMBER: NCBI ACCESSION: NZ_JOPD01000003.1
  ref <309>: DATABASE ENTRY DATE: 2019-04-01
  ref <313>: RELEVANT RESIDUES IN SEQ ID NO: (1)..(1503)

SEQ ID NO: 941 - DNA, 1501 bp, Acetobacter sp. JWB; identical to SEQ ID NO: 930
  ref <308>: DATABASE ACCESSION NUMBER: NCBI ACCESSION: NZ_CP030871.1
  ref <309>: DATABASE ENTRY DATE: 2019-04-01
  ref <313>: RELEVANT RESIDUES IN SEQ ID NO: (1)..(1501)

SEQ ID NO: 942 - DNA, 1503 bp, Acetobacter syzygii
  ref <308>: DATABASE ACCESSION NUMBER: NCBI ACCESSION: NZ_NDFP01000030.1
  ref <309>: DATABASE ENTRY DATE: 2019-04-01
  ref <313>: RELEVANT RESIDUES IN SEQ ID NO: (1)..(1503)
atgaacctgagagtttgatcctggctcagagcgaacgctggcggcatgcttaacacatgcaagtcgcacgaacctttcggggttagtggcggacgggtgagtaacgcgtaggaatctgtccatgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtacagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgactttgtcattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggtgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaaggaactgt

SEQ ID NO: 943 - DNA, 1505 bp, Acetobacter tropicalis; identical to SEQ ID NO: 934
  ref <308>: DATABASE ACCESSION NUMBER: NCBI ACCESSION: NZ_CP022699.1
  ref <309>: DATABASE ENTRY DATE: 2019-04-01
  ref <313>: RELEVANT RESIDUES IN SEQ ID NO: (1)..(1505)

SEQ ID NO: 944 - DNA, 1493 bp, Acetobacteraceae bacterium AT-5844
  ref <308>: DATABASE ACCESSION NUMBER: NCBI ACCESSION: NZ_JH599943.1
  ref <309>: DATABASE ENTRY DATE: 2019-04-01
  ref <313>: RELEVANT RESIDUES IN SEQ ID NO: (1)..(1493)
atgaacttgagagtttgatcctggctcagagtgaacgctggcggcatgcttaacacatgcaagtcgtgcgccccgcaaggggagcggcggacgggtgagtaacacgtaggaatgtgtccggaggtgggggataaccctgggaaactagggctaataccgcatatgggctgaggcccaaagccgtgaggcgccatcggagtagcctgcgcctgattagctagttggtggggtaaaggcctaccaaggcgacgatcagtagctggtctgagaggacgatcagccacactgggactgagacacggcccagactcctacgggaggcagcagtggggaatattggacaatgggcgcaagcctgatccagcaatgccgcgtgtgtgaagaaggtcttcggatcgtaaagcactttcggcggggacgatgatgacggtacccgcagaagaagccccggctaacttcgtgccagcagccgcggtaatacgaagggggctagcgttactcggaattactgggcgtaaagggcgcgtaggcggcgttccaagttaggcgtgaaagtcctgggctcaacctgggaactgcgcttaagactggagtgcttgaggatggaagagggttgtggaattcccagtgtagaggtgaaattcgtagatattgggaagaacaccggtggcgaaggcggcaacctggtccattactgacgctgaggcgcgatagcgtggggagcaaacaggattagataccctggtagtccacgccgtaaacgatgtgcgctggatgttgggggtcctagaccttcagtgtcgtagctaacgcgataagcgcaccgcctggggagtacggccgcaaggttgaaactcaaaggaattgacgggggcccgcacaagcggtggagcatgtggtttaattcgaagcaacgcgcagaaccttaccagctcttgacatgggtaggaccggtgcagagatgcacttttcccgcaagggacctaccgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgggctgggctacacacgtgctacaatggcggtgacaacgggatgccaggcagcgatgccgagccgatcccaaaaagccgtctcagttcagattgcagcctgcaactcggctgcatgaaggtggaatcgctagtaatcgcggatcagcacgccgcggtgaatacgttcccgggccttgtacacaccgcccgtcacaccatgggagttggttttaccttaagtcggtgcggtaaccgcaaggagctagccgaccacggtaggatcagtgactggggtgaagtcgtaacaaggtagccgtaggggaacctgcggctggatcacctcctttcaag

SEQ ID NO: 945 - DNA, 701 bp, Acetobacteraceae bacterium DB1506
  ref <308>: DATABASE ACCESSION NUMBER: NCBI ACCESSION: NZ_QLIX01000042.1
  ref <309>: DATABASE ENTRY DATE: 2019-04-01
  ref <313>: RELEVANT RESIDUES IN SEQ ID NO: (1)..(701)
atgaacctgagagtttgatcctggctcagagcgaacgctggcggcatgcttaacacatgcaagtcgcgcgggcggttttcggatcgtcagcggcggacgggtgagtatcgcgtaggaatgtatcctgaggtgggggacaaccctgggaaactggggctaataccgcatggggcctgtgggtcaaagccgcgaggtgccttgggagcagcctgcgtccgattaggtagttggtggggtaaaggcctaccaagcctgcgatcggtagctggtctgagaggacgatcagccacactgggactgagacacggcccagactcctacgggaggcagcagtggggaatattggacaatgggcgcaagcctgatccagcaatgccgcgtgggtgaagaaggtcttcggattgtaaagccctttcggcggggacgatgatgacggtacccgcagaagaagccccggctaacttcgtgccagcagccgcggtaatacgaagggggctagcgttgctcggaattactgggcgtaaagggcgcgtaggcggccttgttagtcaggcgtgaaattcctgggctcaacctggggactgcgcttgatacggcagggcttgagggcaggagaggctcgcggaattcccagtgtagaggtgaaattcgtagatattgggaagaacaccggtggcgaaggcggcgagctggcctgtgac

SEQ ID NO: 946 - DNA, 1516 bp, Acetobacterium bakii
  ref <308>: DATABASE ACCESSION NUMBER: NCBI ACCESSION: NZ_UOGO01000001.1
  ref <309>: DATABASE ENTRY DATE: 2019-04-01
  ref <313>: RELEVANT RESIDUES IN SEQ ID NO: (1)..(1516)
tttattgagagtttgatcctggctcaggacgaacgctggcggtatgcttaacacatgcaagtcgaacgagacaaaggtgcttgcaccttttgaaagtggcgaacgggtgagtaacgcgtgggtaacctaccctttggaaaggaatagccccgggaaactgggtgtaataccttataagatacgtgagtcgcatggctcgtgtattaaacgctccggcgccataggatggacccgcgtcccattagctagttggtgagataacagctcaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaaaaagacggtacccaagaagaaagttccggctaactacgtgccagcagccgcggtaatacgtagggaacaagcgttgtccggatttactgggcgtaaagggcacgcaggcggtttcttaagtcagatgtgaaaggccacagctcaactgtggacatgcatttgaaactgagagacttgagtattggagaggcaagtggaattcctagtgtagcggtgaaatgcgtagatattaggaggaacaccggtggcgaaggcggcttgctggacaaatactgacgctgaggtgcgaaagcgtggggagcaaacaggattagataccctggtagtccacgccgtaaacgatgagtgctaggtgttggggagactcagtgccgcagttaacacaataagcactccgcctggggagtacgaccgcaaggttgaaactcaaaggaattgacggggacccgcacaagcagcggagcatgtggtttaattcgaagcaacgcgaagaaccttaccaggtcttgacatcctctgaccacccgagagatcgggctttcccttcggggacagagtgacaggtggtgcatggttgtcgtcagctcgtgtcgtgagatgttgggttaagtcccgcaacgagcgcaacccctgtggttagttgccatcatttagttgggcactctaagcagactgccgtggataacacggaggaaggtggggatgacgtcaaatcatcatgccccttatgacctgggctacacacgtgctacaatggtctgaacagagggctgcgaagccgcaaggtgaagccaatcccttaaaacagatctcagttcggattgcaggctgaaactcgcctgcatgaagttggagttgctagtaatcgcggatcagaatgccgcggtgaatgcgttcccgggtcttgtacacaccgcccgtcacaccacgagagttggcaacacccgaagtcagtgagacaaccgtaaggagtcagctgccgaaggtggggtcggtaattggggtgaagtcgtaacaaggtagccgtatcggaaggtgcggctggatcacctcctttctaggga

SEQ ID NO: 947 - DNA, 330 bp, Acetobacterium dehalogenans
  ref <308>: DATABASE ACCESSION NUMBER: NCBI ACCESSION: NZ_AXAC01000024.1
  ref <309>: DATABASE ENTRY DATE: 2019-04-01
  ref <313>: RELEVANT RESIDUES IN SEQ ID NO: (1)..(330)
ttttattgagagtttgatcctggctcaggacgaacgctggcggtatgcttaacacatgcaagtcgaacgagacaaaagagaagtgcttgcacggatcttttagaaagtggcgaacgggtgagtaacgcgtgggtaacctgccctatggaaaggaatagcctcgggaaactgggagtaatgccttataatatatgtttgtcgcatggcagatatattaaacgctccggtgccataggatggacccgcgtcccattagctagttggtgagataacagcccaccaaggcgacgatgggtaaccggtctgagagggcgaacggtcacactggaa

SEQ ID NO: 948 - DNA, 1527 bp, Acetobacterium sp. KB-1
  ref <308>: DATABASE ACCESSION NUMBER: NCBI ACCESSION: NZ_CP030040.1
  ref <309>: DATABASE ENTRY DATE: 2019-04-01
  ref <313>: RELEVANT RESIDUES IN SEQ ID NO: (1)..(1527)
tttattgagagtttgatcctggctcaggacgaacgctggcggtatgcttaacacatgcaagtcgaacgagacaaaagagaagtgcttgcacggatcttttagaaagtggcgaacgggtgagtaacgcgtgggtaacctaccctatggaaaggaatagcctcgggaaactgggagtaatgccttataagatatatttgtcgcatggcagatgtattaaacgctccggtgccataggatggacccgcgtcccattagctagttggtgagataacagctcaccaaggcgacgatgggtaaccggtctgagagggcgaacggtcacactggaactgagacacggtccagactcctacgggaggcagcagtggggaatattgcgcaatgggggaaaccctgacgcagcaataccgcgtgagtgaagaaggttttcggatcgtaaagctctgttattggggaagaaaaaaagacggtacccaagaagaaagtcccggctaactacgtgccagcagccgcggtaatacgtaggggacaagcgttgtccggatttactgggcgtaaagggcacgcaggcggttttttaagtcagatgtgaaaggtaccggctcaaccggtgacatgcatttgaaactgaaagacttgagtattggagaggcaagtggaattcctagtgtagcggtgaaatgcgtagatattaggaggaacaccggtggcgaaggcggcttgctggacaaatactgacgctgaggtgcgaaagcgtggggagcaaacaggattagataccctggtagtccacgccgtaaacgatgagtgctaggtgttggggagactcagtgccgcagctaacgcaataagcactccgcctggggagtacgaccgcaaggttgaaactcaaaggaattgacggggacccgcacaagcagcggagcatgtggtttaattcgaagcaacgcgaagaaccttaccaggtcttgacatcctctgacmaycyragagatyrgrctttyccttcgggracagagagacaggtggtgcatggttgtcgtcagctcgtgtcgtgagatgttgggttaagtcccgcaacgagcgcaacccctgtggttagttgccatcatttagttgggcactctaagcagactgccgtggataacacggaggaaggtggggacgacgtcaaatcatcatgccccttatgacctgggctacacacgtgctacaatggtctgaacagagggctgcgaaaccgcgaggtgaagctaatcccttaaaacagatctcagttcggattgcaggctgcaactcgcctgcatgaagttggagttgctagtaatcgcagatcagaatgctgcggtgaatgcgttcccgggtcttgtacacaccgcccgtcacaccacgagagttggcaacacccgaagtcagtgaggtaaccgtaaggaaccagctgccgaaggtggggtcagtaattggggtgaagtcgtaacaaggtagccgtatcggaaggtgcggctggatcacctcctttctagggaa

SEQ ID NO: 949 - DNA, 1533 bp, Acetobacterium wieringae
  ref <308>: DATABASE ACCESSION NUMBER: NCBI ACCESSION: NZ_LKEU01000008.1
  ref <309>: DATABASE ENTRY DATE: 2019-04-01
  ref <313>: RELEVANT RESIDUES IN SEQ ID NO: (1)..(1533)
ttttattgagagtttgatcctggctcaggacgaacgctggcggtatgcttaacacatgcaagtcgaacgagacgagatggaatgacccttcgggggaatgaaatcttagaaagtggcgaacgggtgagtaacgcgtgggtaacctgccctatggaaaggaatagcctcgggaaactgggagtaatgccttataatacagtgaagtcgcatggctttgctgttaaacgctccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaaaagacggtacccaagaagaaagtcccggctaactacgtgccagcagccgcggtaatacgtaggggacaagcgttgtccggatttactgggcgtaaagggcacgcaggcggttttttaagtcagatgtgaaaggtaccggctcaaccggtgacatgcatttgaaactgaaagacttgagtattggagaggcaagtggaattcctagtgtagcggtgaaatgcgtagatattaggaggaacaccggtggcgaaggcggcttgctggacaaatactgacgctgaggtgcgaaagcgtggggagcaaacaggattagataccctggtagtccacgccgtaaacgatgagtgctaggtgttggggagactcagtgccgcagctaacgcaataagcactccgcctggggagtacgaccgcaaggttgaaactcaaaggaattgacggggacccgcacaagcagcggagcatgtggtttaattcgaagcaacgcgaagaaccttaccaggtcttgacatcctctgacaatctgagagatcagactttcccttcggggacagagagacaggtggtgcatggttgtcgtcagctcgtgtcgtgagatgttgggttaagtcccgcaacgagcgcaacccctgtggttagttgccatcatttagttgggcactctaagcagactgccgtggataacacggaggaaggtggggacgacgtcaaatcatcatgccccttatgacctgggctacacacgtgctacaatggtctgaacagagggctgcgaaaccgcgaggtgaagctaatcccttaaaacagatctcagttcggattgcaggctgcaactcgcctgcatgaagttggagttgctagtaatcgcagatcagaatgctgcggtgaatgcgttcccgggtcttgtacacaccgcccgtcacaccacgagagttggcaacacccgaagtcagtgaggcaaccgcaaggagccagctgccgaaggtggggtcagtaattggggtgaagtcgtaacaaggtagccgtatcggaaggtgcggctggatcacctcctttctagggaa

SEQ ID NO: 950 - DNA, 1534 bp, Acetobacterium woodii
  ref <308>: DATABASE ACCESSION NUMBER: NCBI ACCESSION: NC_016894.1
  ref <309>: DATABASE ENTRY DATE: 2019-04-01
  ref <313>: RELEVANT RESIDUES IN SEQ ID NO: (1)..(1534)
ttttattgagagtttgatcctggctcaggacgaacgctggcggtatgcttaacacatgcaagtcgaacgagacaagatggaaggatccttcgggtgaatgaaatcttagaaagtggcgaacgggtgagtaacgcgtgggtaacctaccctatggaaaggaatagccccgggaaactgggtgtaataccttataagatatgtttgtcgcatggcagatgtattaaacgctccggcgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaaaaagacggtacccaagaagaaagtcccggctaactacgtgccagcagccgcggtaatacgtaggggacaagcgttgtccggatttactgggcgtaaagggcacgcaggcggttttttaagtcagatgtgaaaggtaccggctcaaccggtgacatgcatttgaaactgaaagacttgagtattggagaggcaagtggaattcctggtgtagcggtgaaatgcgtagatatcaggaggaacaccggtggcgaaggcggcttgctggacaaatactgacgctgaggtgcgaaagcgtggggagcaaacaggattagataccctggtagtccacgccgtaaacgatgagtgctaggtgttggggagactcagtgccgcagctaacgcaataagcactccgcctggggagtacgaccgcaaggttgaaactcaaaggaattgacggggacccgcacaagcagcggagcatgtggtttaattcgaagcaacgcgaagaaccttaccaggtcttgacatcctctgaccatctgagagatcagactttcccttcggggacagagagacaggtggtgcatggttgtcgtcagctcgtgtcgtgagatgttgggttaagtcccgcaacgagcgcaacccctgtggttagttgccatcatttagttgggcactctaagcagactgccgtggataacacggaggaaggtggggacgacgtcaaatcatcatgccccttatgacctgggctacacacgtgctacaatggtctgaacagagggctgcgaaaccgcgaggtgaagctaatcccttaaaacagatctcagttcggattgcaggctgcaactcgcctgcatgaagttggagttgctagtaatcgcagatcagaatgctgcggtgaatgcgttcccgggtcttgtacacaccgcccgtcacaccacgagagttggcaacacccgaagtcagtgaggcaaccgtaaggagccagctgccgaaggtggggtcagtaattggggtgaagtcgtaacaaggtagccgtatcggaaggtgcggctggatcacctcctttctagggaa

SEQ ID NO: 951 - DNA, 1541 bp, Acetohalobium arabaticum
  ref <308>: DATABASE ACCESSION NUMBER: NCBI ACCESSION: NC_014378.1
  ref <309>: DATABASE ENTRY DATE: 2019-04-01
  ref <313>: RELEVANT RESIDUES IN SEQ ID NO: (1)..(1541)
ttttatcggagagtttgatcctggctcaggacgaacgctggcggcgtgcctaacacatgcaagtcgcgcgagaaagctgctctttgagcagttagtaaagcggcggacgggtgagtaacgcgtgagtaatctacctttaagtctgatataacttctcgaaagggaagctaatttcggatattatgctgcctggataaccaggctgcatcaaaggcggctttttgcctccgcttttagatgtgctcgcgtcccattagcttgttggtgagataacagctcaccaaggctgcgatgggtagccgacctgagagggtgatcggccacactgggactgagacacggcccagactcctacgggaggctgcagtggggaatctttcgcaatgagcgcaagcttgacgaagcgacgccgcgtgagtgatgaaggccttcgggtcgtaaagctctgtcctcagggaagaacatcttagtagtgaataactgctaggcttgacggtacctgagaagaaagctccggctaactacgtgccagcagccgcggtaatacgtagggagcaagcgttgtccggaatcattgggcgtaaagggtgcgcaggcggtctggcaagtcaagtgtgaaatgtatcggcttaactgatacactgcgcttgaaactgtcagacttgagggcaagagaagagagcggaattcctagtgtagcggtgaaatgcgtagatattaggaagaacaccagtggcgaaagcggctctctggcttgaccctgacgctgaggcacgaaagctaggggagcgaacgggattagataccccggtagtcctggctgtaaacgctggatactaggtgttgggggttcaactccctcagtgctgcagttaacgcgttaagtatcccgcctggggattacgaccgcaaggttgaaactcaaaggaattgacgggggcctgcacaagcggcggagcatgtggtttaattcgaagcaacgcgcagaaccttaccagggcttgacatcccgtgactatctgtcaacagcagaatttggtcctttggatcacacggtgacaggtggtgcatggctgtcgtcagctcgtgtcgtgagatgttgggttaagtcccgcaacgagcgtaacccctatccttagttgccagcattaagttggggactctagggagactgccagtcaaaaactggaggaaggtggggatgacgtcaagtcatcatgccccttatgctctgggctacacacgtgctacaatggcctgtacagagggctgctataccgcaaggtttagccaatcctcaaaacaggtcccagttcggattgctggctgcaactcgcctgcatgaagctggagtcgctagtaatcgcggatcagaatgccgcggtgaatccgttcccaggccttgtacacaccgcccgtcacaccacccgagttggatgcaccagaagtcgtctacgggcgccgaaggtgtgtccgataaggggggtgaagtcgtaacaaggtagccgtatcggaaggtgcggctggatcacctcctttct

SEQ ID NO: 952 - DNA, 1540 bp, Acetomicrobium flavidum
  ref <308>: DATABASE ACCESSION NUMBER: NCBI ACCESSION: NZ_FSQZ01000001.1
  ref <309>: DATABASE ENTRY DATE: 2019-04-01
  ref <313>: RELEVANT RESIDUES IN SEQ ID NO: (1)..(1540)
attgaacggagagtttgatcctggctcaggacgaacgctggcggcgcgcttaacacatgcaagtcgtgcggtgtcgaaggcaagtcttacgacaagccttcgacacagcggcgaacgggtgagtaacacgtgagtagctgtcctaaggagggggataacgcctggaaacgggtgctaataccccatatgcctcgcaagaggtgaaagtgtacttgttacagccttagggtgtgctcgcggcctatcagctagttggtgaggtaacggctcaccaaggctaagacgggtagccggcctgagagggtgtacggccacactggaattgagatacggtccagactcctacgggaggcagcagtggggaatcttgggcaatgggcgaaagcctgacccagcgacgccgcgttggggatgaagcccttcggggcgtaaacccatgttgtaggggacgaagaaagtgacggtaccctacgagaaagccccggccaactacgtgccagcagccgcggtaaaacgtagggggcgagcgttgtccggaattactgggcgtaaagggcacgcaggcggtacgccaagtcgggggtgtaaagttacggctcaaccgtgaccttgcaatcgatactggcgtactggagtgcgggagagggaagtggaattcccggtgtagcggtgaaatgcgtagatatcgggaggaacgccagtggcgaaggcggcttcctggcccgcgactgacgctcatgtgcgaaagccaggggagcgaaccggattagatacccgggtagtcctggccgtaaacgatgggtgctaggtgtaggcgcgtcaagcgtctgtgccgcagttaacgcgataagcacctcgcctggggagtacggtcgcaaggctgaaactcaaaggaattgacgggggcccgcacaagcggtggagcacgtggtttaattcgatgcaaaccgaagaaccttacctgggtttgacatgcaggtggtacgagcctgaaagggcaaggaccgcatcttcggatgcggagcctgcacaggtgctgcatggctgtcgtcagctcgtgtcgtgagatgttgggttaagtcccgcaacgagcgcaacccctgcgcctagttgccatcagttaggctgggcactctaggcggactgccggcgacaagtcggaggaaggtggggatgacgtcaagtcatcatggcctttaagcccagggcgacacacgtgctacaatggccagcacagagggctgcaagtccgcgaggacaagcgaatcccttaaagctggtctcagttcggattgcagtctgcaactcgactgcatgaagccggaatcgctagtaatcgccggtcagccatacggcggtgaatacgttcccgggccttgtacacaccgcccgtcacaccacccgagttgggtgctcccgaagccgccggcccaaccccgtaaggggagggaggcgtcgaaggagtgtctgataaggggggtgaagtcgtaacaaggtagccgtaccggaaggtgcggctggatcacctcctttctaagga

SEQ ID NO: 953 - DNA, 1537 bp, Acetomicrobium hydrogeniformans
  ref <308>: DATABASE ACCESSION NUMBER: NCBI ACCESSION: NZ_ACJX03000001.1
  ref <309>: DATABASE ENTRY DATE: 2019-04-01
  ref <313>: RELEVANT RESIDUES IN SEQ ID NO: (1)..(1537)
aacggagagtttgatcctggctcaggacgaacgctggcggcgcgcttaacacatgcaagtcgtgcgatacctcgagcgagtcttacgacaagctcaaggtagagcggcggacgggtgagtaacacgtgagtagctgtcctaaggagggggataacgcctggaaacgggtgctaaaaccccatatgcctcgcaagaggtgaaaatgtagcttgctacagccttagggtgtgctcgcggcctatcagctagttggtgaggtaacggctcaccaaggctaagacgggtagccggcctgagagggtgtacggccacactggaattgagatacggtccagactcctacgggaggcagcagtggggaatcttgggcaatgggcgaaagcctgacccagcgacgccgcgttggggatgaagcccttcggggtgtaaacccatgttgtaggggacgaagaaagtgacggtaccctacgaggaagccccggctaactacgtgccagcagccgcggtaagacgtagggggcaagcgttgtccggaattactgggcgtaaagggcacgcaggcggtgcgccaagtcgagggtgtaaagttacggctcaaccgtgacattgcaatcgatactggcgcgctggagtgcgggagagggaagtggaattcccggtgtagcggtgaaatgcgtagatatcgggaggaacgccagtggcgaaggcggcttcctggcccgcgactgacgctcatgtgcgaaagccaggggagcgaaccggattagatacccgggtagtcctggccgtaaacgatgggtgctaggtgtaggcgcgtcaagcgtctgtgccgcagttaacgcgataagcacctcgcctggggagtacggtcgcaaggctgaaactcaaaggaattgacgggggcccgcacaagcggtggagcacgtggtttaattcgatgcaaaccgaagaaccttacctgggtttgacatgcaggtggtacgaacctgaaagggcgaggaccatatcttcggatgtggagcctgcacaggtgctgcatggctgtcgtcagctcgtgtcgtgagatgttgggttaagtcccgcaacgagcgcaacccctgcgcctagttgccatcagttaggctgggcactctaggcggactgccggcgacaagtcggaggaaggtggggatgacgtcaagtcatcatggcctttaagcccagggcgacacacgtgctacaatggccagcacagagggcggcaagtccgcgagggcaagcgaatcccttaaagctggtcttagttcggatcgcagtctgcaacccgactgcgtgaagccggaatcgctagtaatcgccggtcagccatacggcggtgaatacgttcccgggccttgtacacaccgcccgtcacaccacccgagttgggtgctcccgaagccgccggcccaacccctttttggggagggaggcgtcgaaggagtgtctgataaggggggtgaagtcgtaacaaggtagccgtaccggaaggtgcggctggatcacctcctttctaagg

SEQ ID NO: 954 - DNA, 1537 bp, Achromobacter agilis
  ref <308>: DATABASE ACCESSION NUMBER: NCBI ACCESSION: NZ_UFQB01000054.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaataccccgcggaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaaggtagccgtatcggaaggtgcggctggatcacctcctttc

SEQ ID NO: 955 - DNA, 1537 bp, Achromobacter aloeverae
  ref <308>: DATABASE ACCESSION NUMBER: NCBI ACCESSION: NZ_PYAL01000012.1
  ref <309>: DATABASE ENTRY DATE: 2019-04-01
  ref <313>: RELEVANT RESIDUES IN SEQ ID NO: (1)..(1537)
agattgaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcgggggatcgcaagacctcgcactattggagcggccgatatcggattagctagttggtgaggtaaaggctcaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacggcgctggttaatacctggcgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagaggggggtggaattccacgtgtagcagtgaaatgcgtagatatgtggaggaacaccgatggcgaaggcagccccctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaaggtagccgtatcggaaggtgcggctggatcacctcctttc

SEQ ID NO: 956 - DNA, 1537 bp, Achromobacter denitrificans
  ref <308>: DATABASE ACCESSION NUMBER: NCBI ACCESSION: NZ_UAPD01000031.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgtaaggggggcgattaccacggtaggattcatgactggggtgaagtcgtaacaaggtagccgtatcggaaggtgcggctggatcacctcctttc

SEQ ID NO: 957 - DNA, 1537 bp, Achromobacter denitrificans
agattaaactgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaactggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 958 - DNA, 1537 bp, Achromobacter dolens
  ref <308>: DATABASE ACCESSION NUMBER: NCBI ACCESSION: NZ_QENF01000071.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgtgggttaataccccgcgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggtagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 959 - DNA, 1537 bp, Achromobacter insolitus
  ref <308>: DATABASE ACCESSION NUMBER: NCBI ACCESSION: NZ_LR134361.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgtgggttaataccccgcgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 960 - DNA, 1537 bp, Achromobacter insuavis
  ref <308>: DATABASE ACCESSION NUMBER: NCBI ACCESSION: NZ_QENG01000123.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggtagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 961 - DNA, 1537 bp, Achromobacter marplatensis
  ref <308>: DATABASE ACCESSION NUMBER: NCBI ACCESSION: NZ_QNRM01000032.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgtaaggggggcgattaccacggtaggattcatgactggggtgaagtcgtaacaaggtagccgtatcggaaggtgcggctggatcacctcctttc

SEQ ID NO: 962 - DNA, 1537 bp, Achromobacter mucicolens
  ref <308>: DATABASE ACCESSION NUMBER: NCBI ACCESSION: NZ_QAYS01000115.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgtaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgttccgggttaataccccgggaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagctaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaaggtagccgtatcggaaggtgcggctggatcacctcctttc

SEQ ID NO: 963 - DNA, 469 bp, Achromobacter pulmonis
  ref <308>: DATABASE ACCESSION NUMBER: NCBI ACCESSION: NZ_POQS01000009.1
  ref <309>: DATABASE ENTRY DATE: 2019-04-01
  ref <313>: RELEVANT RESIDUES IN SEQ ID NO: (1)..(469)
agattgaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcttcggaccttgcactattggagcggccgatatcggattagctagttggtggggtaacggcctaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggctaatacc

SEQ ID NO: 964 - DNA, 1537 bp, Achromobacter pulmonis
agattaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaataccccgcggaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggtcttcggaccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaactggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 965 - DNA, 1537 bp, Achromobacter sp. 270
  ref <308>: DATABASE ACCESSION NUMBER: NCBI ACCESSION: NZ_RHXM01000125.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 966 - DNA, 1537 bp, Achromobacter sp. AONIH1
  ref <308>: DATABASE ACCESSION NUMBER: NCBI ACCESSION: NZ_CP026124.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgctttacacatgcaagtcgaacggcagcgcggacttcggtctggcggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtgaggtaacggctcaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacgtcgcgggctaataccccgtggaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 967 - DNA, 1537 bp, Achromobacter sp. B7; identical to SEQ ID NO: 956
  ref <308>: DATABASE ACCESSION NUMBER: NCBI ACCESSION: NZ_CP032084.1
  ref <309>: DATABASE ENTRY DATE: 2019-04-01
  ref <313>: RELEVANT RESIDUES IN SEQ ID NO: (1)..(1537)

SEQ ID NO: 968 - DNA, 1537 bp, Achromobacter sp. DH1f
  ref <308>: DATABASE ACCESSION NUMBER: NCBI ACCESSION: NZ_AYMF01000052.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatttcgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 969 - DNA, 1537 bp, Achromobacter sp. HZ01
  ref <308>: DATABASE ACCESSION NUMBER: NCBI ACCESSION: NZ_LWKV01000011.1
  ref <309>: DATABASE ENTRY DATE: 2019-04-01
  ref <313>: RELEVANT RESIDUES IN SEQ ID NO: (1)..(1537)
agattgaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcttcggaccttgcactattggagcggccgatatcggattagctagttggtggggtaacggcctaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggctaataccccgcgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagctaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgtaaggagggcgattaccacggtaggattcatgactggggtgaagtcgtaacaaggtagccgtatcggaaggtgcggctggatcacctcctttc

SEQ ID NO: 970 - DNA, 1537 bp, Achromobacter sp. K91
  ref <308>: DATABASE ACCESSION NUMBER: NCBI ACCESSION: NZ_QWFB01000087.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 971 - DNA, 1537 bp, Achromobacter sp. LMG 30378
  ref <308>: DATABASE ACCESSION NUMBER: NCBI ACCESSION: NZ_UFQC01000090.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtggctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaataccccgcggaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaaggtagccgtatcggaaggtgcggctggatcacctcctttc

SEQ ID NO: 972 - DNA, 1537 bp, Achromobacter sp. MYb9
  ref <308>: DATABASE ACCESSION NUMBER: NCBI ACCESSION: NZ_PCOQ01000052.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaactggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 973 - DNA, 1537 bp, Achromobacter sp. RW408
  ref <308>: DATABASE ACCESSION NUMBER: NCBI ACCESSION: NZ_QHHO01000046.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaataccccgcgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 974 - DNA, 1537 bp, Achromobacter spanius; identical to SEQ ID NO: 956
  ref <308>: DATABASE ACCESSION NUMBER: NCBI ACCESSION: NZ_LR134302.1
  ref <309>: DATABASE ENTRY DATE: 2019-04-01
  ref <313>: RELEVANT RESIDUES IN SEQ ID NO: (1)..(1537)

SEQ ID NO: 975 - DNA, 1537 bp, Achromobacter xylosoxidans
  ref <308>: DATABASE ACCESSION NUMBER: NCBI ACCESSION: NZ_LS483395.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaatacctcgcgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 976 - DNA, 1565 bp, Acidaminococcus intestini
  ref <308>: DATABASE ACCESSION NUMBER: NCBI ACCESSION: NZ_AULA01000029.1
  ref <309>: DATABASE ENTRY DATE: 2019-04-01
  ref <313>: RELEVANT RESIDUES IN SEQ ID NO: (1)..(1565)
ttttggagagtttgatcctggctcaggacgaacgctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtgctccctcctccgcatggaggagggaggaaagatggcctctgcttgcaagctatcgctggaagatgggcccgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtcccgcaacgagcgcaacccctatcctatgttaccagcgcgtaatggcggggactcataggagactgccagggataacttggaggaaggcggggatgacgtcaagtcatcatgccccttatgtcttgggctacacacgtactacaatggtcggcaacaaagggcagcgaaaccgcgaggtggagcaaatcccagaaacccgaccccagttcggatcgtaggctgcaacccgcctacgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagccgttcgagaacgagcggctggatcacctcctttctatggaga

SEQ ID NO: 977 - DNA, 1568 bp, Acidaminococcus massiliensis
  ref <308>: DATABASE ACCESSION NUMBER: NCBI ACCESSION: NZ_LT608315.1
  ref <309>: DATABASE ENTRY DATE: 2019-04-01
  ref <313>: RELEVANT RESIDUES IN SEQ ID NO: (1)..(1568)
ctattttggagagtttgatcctggctcaggacgaacgctggcggcgtgcttaacacatgcaagtcgaacggagaactttcttcggaatgttcttagtggcgaacgggtgagtaacgcgtaggcaacctgccctctggttggggacaacattccgaaagggatgctaataccgaatgtgatcccctctccgcatggagaggggatgaaagatggcctctacttgtaagctatcgccagaagatgggcctgcgtctgattagctagtaggtggggtaacggcccacctaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggccttcgggttgtaaaactctgttgtcagggacgaacgtgccgatctacaatacatttcggcagtgacggtacctgacgaggaagccacggctaactacgtgccagcagccgcggtaatacgtaggtggcaagcgttgtccggaattattgggcgtaaagagcatgtaggcgggcttttaagtccgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatgggtactaggtgtaggaggtatcgaccccttctgtgccggagttaacgcaataagtaccccgcctggggactacgatcgcaagattgaaactcaaaggaattgacgggggcccgcacaagcggtggagtatgtggtttaattcgacgcaacgcgaagaaccttaccaaggcttgacattgagtgaaaggcttagagataagcccctctcttcggagacacgaaaacaggtggtgcatggctgtcgtcagctcgtgtcgtgagatgttgggttaagtcccgcaacgagcgcaacccttatcctatgttaccagcacgcagcggtggggactcataggagactgccagggataacctggaggaaggcggggatgacgtcaagtcatcatgccccttatgtcttgggctacacacgtactacaatggtcggcaacaaagggcagcgaagccgcgaggcggagccaatcccagaaacccgaccccagttcggatcgcaggctgcaacccgcctgcgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagccgttcgagaacgagcggctggatcacctcctttctagggaga

SEQ ID NO: 978 - DNA, 1558 bp, Acidaminococcus sp. AM05-11
  ref <308>: DATABASE ACCESSION NUMBER: NCBI ACCESSION: NZ_QRMX01000064.1
  ref <309>: DATABASE ENTRY DATE: 2019-04-01
  ref <313>: RELEVANT RESIDUES IN SEQ ID NO: (1)..(1558)
ttttggagagtttgatcctggctcaggacgaacgctggcggcgtgcttaacacatgcaagtcgaacggagaatttatttcggtaaattcttagtggcgaacgggtgagtaacgcgtaggcaacctgccctccagttggggacaacattccgaaaggaatgctaataccgaatgtgatccttcttccgcatggaggaaggatgaaagatggcctctatttataagctatcgctggaagatgggcctgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgtcagggacgaatgtgcgaacgttgaataagcgtttgtattgacggtacctgacgaggaagccacggctaactacgtgccagcagccgcggtaatacgtaggtggcaagcgttgtccggaattattgggcgtaaagagcatgtaggcgggcttttaagtccgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatgggtactaggtgtaggaggtatcgaccccttctgtgccggagttaacgcaataagtaccccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccctctcttcggagacacgaaaacaggtggtgcatggctgtcgtcagctcgtgtcgtgagatgttgggttaagtcccgcaacgagcgcaacccttatcctatgttaccagcgcgtaatggcggggactcataggagactgccagggataacctggaggaaggcggggatgacgtcaagtcatcatgccccttatgtcttgggctacacacgtactacaatggtcggcaacaaagggcagcaaagccgcgaggcagagcaaatcccataaacccgaccccagttcggatcgcaggctgcaacccgcctgcgtgaagttggaatcgctagtaatcgcaggtcagcatactgcggtgaatacgttcccgggccttgtacacaccgcccgtcacaccacgaaagttggtaacacccgaagccggtgagataaccgtaaggagtcagctgtctaaggtggggccgatgattggggtgaagtcgtaacaaggtagccgttcgagaacgagcggctggatcacctcctttcta

SEQ ID NO: 979 - DNA, 1559 bp, Acidaminococcus sp. AM33-14BH
  ref <308>: DATABASE ACCESSION NUMBER: NCBI ACCESSION: NZ_QTNG01000023.1
  ref <309>: DATABASE ENTRY DATE: 2019-04-01
  ref <313>: RELEVANT RESIDUES IN SEQ ID NO: (1)..(1559)
ttttggagagtttgatcctggctcaggacgaacgctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtgctccctcctccgcatggaggagggaggaaagatggcctctgcttgcaagctatcgctggaagatgggcccgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtcccgcaacgagcgcaacccctatcctatgttaccagcgcgtaatggcggggactcataggagactgccagggataacttggaggaaggcggggatgacgtcaagtcatcatgccccttatgtcttgggctacacacgtactacaatggtcggcaacaaagggcagcgaaaccgcgaggtggagcaaatcccagaaacccgaccccagttcggatcgtaggctgcaacccgcctacgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagccgttcgagaacgagcggctggatcacctcctttcta

SEQ ID NO: 980 - DNA, 1565 bp, Acidaminococcus sp. BV3L6; identical to SEQ ID NO: 976
  ref <308>: DATABASE ACCESSION NUMBER: NCBI ACCESSION: NZ_AWUR01000027.1
  ref <309>: DATABASE ENTRY DATE: 2019-04-01
  ref <313>: RELEVANT RESIDUES IN SEQ ID NO: (1)..(1565)

SEQ ID NO: 981 - DNA, 1565 bp, Acidaminococcus sp. HPA0509
  ref <308>: DATABASE ACCESSION NUMBER: NCBI ACCESSION: NZ_KE150449.1
  ref <309>: DATABASE ENTRY DATE: 2019-04-01
  ref <313>: RELEVANT RESIDUES IN SEQ ID NO: (1)..(1565)
ttttggagagtttgatcctggctcaggacgaacgctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtgctccctcctccgcatggaggagggaggaaagatggcctctgcttgcaagctatcgctggaagatgggcccgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtcccgcaacgagcgcaacccctatcctatgttaccagcgcgtaaaggcggggactcataggagactgccagggataacttggaggaaggcggggatgacgtcaagtcatcatgccccttatgtcttgggctacacacgtactacaatggtcggcaacaaagggcagcgaaaccgcgaggtggagcaaatcccagaaacccgaccccagttcggatcgtaggctgcaacccgcctacgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagccgttcgagaacgagcggctggatcacctcctttctatggaga

SEQ ID NO: 982 - DNA, 1558 bp, Acidaminococcus sp. Marseille-P4266
  ref <308>: DATABASE ACCESSION NUMBER: NCBI ACCESSION: NZ_OLMM01000005.1
  ref <309>: DATABASE ENTRY DATE: 2019-04-01
  ref <313>: RELEVANT RESIDUES IN SEQ ID NO: (1)..(1558)
ttttggagagtttgatcctggctcaggacgaacgctggcggcgtgcttaacacatgcaagtcgaacggagaatttatttcggtaaattcttagtggcgaacgggtgagtaacgcgtaggcaacctgccctccagttggggacaacattccgaaaggaatgctaataccgaatgtgatcccttttccgcatggagaagggatgaaagatggcctctatttataagctatcgctggaagatgggcctgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgtcagggacgaatgtgcgaacgttgaataagcgtttgtattgacggtacctgacgaggaagccacggctaactacgtgccagcagccgcggtaatacgtaggtggcaagcgttgtccggaattattgggcgtaaagagcatgtaggcgggcttttaagtccgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatgggtactaggtgtaggaggtatcgaccccttctgtgccggagttaacgcaataagtaccccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccccttcttcggaagcacgaaaacaggtggtgcatggctgtcgtcagctcgtgtcgtgagatgttgggttaagtcccgcaacgagcgcaacccttatcctatgttaccagcacgtaatggtggggactcataggagactgccagggataacctggaggaaggcggggatgacgtcaagtcatcatgccccttatgtcttgggctacacacgtactacaatggtcggcaacaaagggcagcaaagccgcgaggcagagcaaatcccataaacccgaccccagttcggatcgcaggctgcaacccgcctgcgtgaagttggaatcgctagtaatcgcaggtcagcatactgcggtgaatacgttcccgggccttgtacacaccgcccgtcacaccacgaaagttggtaacacccgaagccggtgagataaccgtaaggagtcagctgtctaaggtggggccgatgattggggtgaagtcgtaacaaggtagccgttcgagaacgagcggctggatcacctcctttcta

SEQ ID NO: 983 - DNA, 1568 bp, Acidaminococcus timonensis
  ref <308>: DATABASE ACCESSION NUMBER: NCBI ACCESSION: NZ_FNWH01000005.1
  ref <309>: DATABASE ENTRY DATE: 2019-04-01
  ref <313>: RELEVANT RESIDUES IN SEQ ID NO: (1)..(1568)
ctattttggagagtttgatcctggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcccgcctccgcatggaggcgggaggaaagatggcctctacttgtaagctatcgccagaagatgggcctgcgtctgattagctagtaggtggggtaacggctcacctaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgtcagggacgaatgtactgatctacaatacatttcggtattgacggtacctgacgaggaagccacggctaactacgtgccagcagccgcggtaatacgtaggtggcaagcgttgtccggaattattgggcgtaaagagcatgtaggcgggcttttaagtccgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatgggtactaggtgtaggaggtatcgaccccttctgtgccggagttaacgcaataagtaccccgcctggggactacgatcgcaagattgaaactcaaaggaattgacgggggcccgcacaagcggtggagtatgtggtttaattcgacgcaacgcgaagaaccttaccaaggcttgacattgagtgaaagacttagagataagtccctctcttcggagacacgaaaacaggtggtgcatggctgtcgtcagctcgtgtcgtgagatgttgggttaagtcccgcaacgagcgcaacccttatcctatgttaccagcacgttatggtggggactcataggagactgccagggataacctggaggaaggcggggatgacgtcaagtcatcatgccccttatgtcttgggctacacacgtactacaatggtcggcaacaaagggcagcgaagccgcgaggtggagcaaatcccagaaacccgaccccagttcggatcgcaggctgcaacccgcctgcgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagccgttcgagaacgagcggctggatcacctcctttctatggaga

SEQ ID NO: 984 - DNA, 1138 bp, Acidibacillus ferrooxidans
  ref <308>: DATABASE ACCESSION NUMBER: NCBI ACCESSION: NZ_MWPS01000024.1
  ref <309>: DATABASE ENTRY DATE: 2019-04-01
  ref <313>: RELEVANT RESIDUES IN SEQ ID NO: (1)..(1138)
ttgagagtttgatcctggctcaggacgaacgctggcggcgtgcctaatacatgcaagtcgagcgctcttttccttcggggaaagggagcggcggacgggtgagtaacacgtgggtaacctgccgttcagatggggataacgcctggaaacgggtgctaatcccgaatgggatccctgctcgcatgggcggggaaggaaaggcgcttctggcgtcgctgaacgatgggcccgcggcgcattagctggttggtggggtaacggcctaccaaggcgacgatgcgtagccgacctgagagggtgaccggccacactgggactgagacacggcccagactcctacgggaggcagcagtagggaatcttccgcaatgggcgaaagcctgacggagcaacgccgcgtgaatgaagacggtcttcggattgtaaagttctgtcatttgggacgagcgaccttgagaggaaatgctcgaggtgagacggtaccaaaggaggaagccccggctaactacgtgccagcagccgcggtaatacgtagggggcaagcgttgtccggaatgactgggcgtaaagcgcgcgcaggcggtctttcgcgtctggggtgaaaggtcagggctcaaccctgacatggccttggaaacggggagacttgagggtcggagaggtcaggggaattccacgtgtagcggtgaaatgcgtagatatgtggaggaataccagtggcgaaggcgcctgactggacgaaacctgacgctgaggcgcgaaggcgtggggagcaaacaggattagataccctggtagtccacgcggtaaacgatgagtgctaggtgtcggagggtaccacctccggtgccgaaggaaacccactaagcactccgcctggggagtacggtcgcaagactgaaactcaaaggaattgacgggggcccgcacaagcagtggagcatgtggtttaattcgaagcaacgcgaagaaccttaccagggcttgacatcggcgtgacgggatcagagatgatccgtcccttcggggcacgctagacaggtggtgcatggttgtcgtcagctcgtgtcgtgagatgttgggttaagtcccgcaacgagcgcaacccttgatcgatgttaccagcgcgtaaaggcgg

SEQ ID NO: 985 - DNA, 1542 bp, Acidibacillus sulfuroxidans
  ref <308>: DATABASE ACCESSION NUMBER: NCBI ACCESSION: NZ_MPDK01000002.1
  ref <309>: DATABASE ENTRY DATE: 2019-04-01
  ref <313>: RELEVANT RESIDUES IN SEQ ID NO: (1)..(1542)
ttaagagtttgatcctggctcaggacgaacgctggcggcgtgcctaatacatgcaagtcgagcggatggatgtaacaatccatgagcggcggacgggtgagtaacacgtgggtaacctaccttttagacggggataacgcctggaaacgggtgctaatcccggatgggatctttcttcgcatgaaggaggaaggaaaggcgcagacaagcgctgctaagagatgggcccgcggcgcattagctagttggtggggtaaaggctcaccaaggcgacgatgcgtagccgacctgagagggtgaccggccacactgggactgagacacggcccagactcctacgggaggcagcagtagggaatcttccgcaatgggcgaaagcctgacggagcaacgccgtgtgagcgaagacggtcttcggattgtaaagctctgtcatttgggacgagaggcatggagagggaatgctcgatgtgagacggtaccaaaggaggaagccccggctaactacgtgccagcagccgcggtaatacgtagggggcaagcgttgtccggaatgactgggcgtaaagcgcgcgcaggcggtttcttgcgtctgaggtgaaaggccagggctcaaccctgggatggccttggaaacgggggaacttgagggtcggagaggcaaggggaattccacgtgtagcggtgaaatgcgtagagatgtggaggaataccagtggcgaaggcgccttgctggacgaaacctgacgctgaggcgcgaaggcgtggggagcaaacaggattagataccctggtagtccacgcggtaaacgatgagtgctaggtgtcggagggtaccacctccggtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatcggcgtgaccggatctgagaagatccctcccctttggggcacgctagacaggtggtgcatggttgtcgtcagctcgtgtcgtgagatgttgggttaagtcccgcaacgagcgcaacccttgatctgtgttaccagcacgtagaggtggggactcacagatgactgccggtgacaaaccggaggaaggcggggatgacgtcaaatcatcatgccccttatgtcctgggcgacacacgtgctacaatgggcggtacaacgggaagcgaagctgcgaagtggagcgaaccccgaaaagccgttcgtagttcggattgcaggctgcaactcgcctgcatgaagccggaattgctagtaatcgcggatcagcatgccgcggtgaatacgttcccgggccttgtacacaccgcccgtcacaccacgagagtgggtaacacccgaagtcggtgaggtaacccgcgagggggccagccgccgaaggtgggattcgcgattggggtgaagtcgtaacaaggtagccgtatcggaaggtgcggctggatcacctcctttcta

SEQ ID NO: 986 - DNA, 1533 bp, Acidiferrobacter sp. SPIII 3
  ref <308>: DATABASE ACCESSION NUMBER: NCBI ACCESSION: NZ_CP027663.1
  ref <309>: DATABASE ENTRY DATE: 2019-04-01
  ref <313>: RELEVANT RESIDUES IN SEQ ID NO: (1)..(1533)
aattggagagtttgatcctggctcagattgaacgctggcggcatgcttaacacatgcaagtcgaacgcgaaagggggcaaccccgagtagagtggcggacgggtgagtaacgcgtaggaatctgcccagtagtgggggataacccggcgaaagccgggctaataccgcatatgccctatggggcaaagcaggggatcttcggaccttgcgctattggatgagcctgcgtcggattagctagttggtagggtaaaggcctaccaaggcgacgatccgtagctggtctgagaggatgatcagccacactgggactgagacacggcccagactcctacgggaggcagcagtggggaatattggacaatgggggaaaccctgatccagcaatgccgcgtgtgtgaagaaggccttcgggttgtaaagcactttcagtagggaagaaaaaagcctggctaatatccaggctcttgacggtacctaaagaagaagcaccggctaactctgtgccagcagccgcggtaatacagagggtgcaagcgttaatcggaattactgggcgtaaagcgtgcgtaggtggttcggtaagtcagatgtgaaagccctgggcttaacctgggaattgcgtttgatactgtcggactagagtttggtagagggaagtggaattccacgtgtagcggtgaaatgcgtagatatgtggaggaacaccagtggcgaaggcggcttcctggactaaaactgacactgaggcacgaaagcgtggggagcaaacaggattagataccctggtagtccacgccgtaaacgatgggtactagacgttgggaggtttaaccttctagtgtcgcagctaacgcaataagtaccccgcctggggagtacggccgcaaggttaaaactcaaaggaattgacgggggcccgcacaagcggtggagcatgtggtttaattcgatgcaacgcgaaaaaccttacctgcccttgacatgtgaggaacctcccagagatgggagggtgcccgcaagggagcctcaacacaggtgctgcatggctgtcgtcagctcgtgtcgtgagatgttgggttaagtcccgtaacgagcgcaacccttgcccttagttgccatcattcagttgggcactctaaggggaccgccggtgacaaaccggaggaaggtggggatgacgtcaagtcatcatggcccttatgggcagggctacacacgtgctacaatggccggtacagagggttgccaacccgcgagggggagctaatctcagaaagccggtcgtagtccggattggagtctgcaactcgactccatgaagtcggaatcgctagtaatcgcgaatcagcatgtcgcggtgaatacgttcccgggccttgtacacaccgcccgtcacaccatgggagttggttgtaccagaagcaggtagcctaaccgcaaggagggcgcctaccacggtatggtcaatgactggggtgaagtcgtaacaaggtagccgtaggggaacctgcggctggatcacctcctttc

SEQ ID NO: 987 - DNA, 1497 bp, Acidiphilium angustum
  ref <308>: DATABASE ACCESSION NUMBER: NCBI ACCESSION: NZ_JNJH01000063.1
  ref <309>: DATABASE ENTRY DATE: 2019-04-01
  ref <313>: RELEVANT RESIDUES IN SEQ ID NO: (1)..(1497)
atgaacatgagagtttgatcctggctcagagcgaacgctggcggcatgcttaacacatgcaagtcgcacgggcagtagcaatattgtcagtggcggacgggtgagtaacgcgtaggaatctatccttggatgggggacaaccgtgggaaactacggctaataccgcataatgcctgagggccaaagacgtaagtcgtctggggaggagcctgcgtctgattaggtagttggtggggtaaaggcctaccaagcctgcgatcagtagctggtctgagaggatgatcagccacattgggactgagacacggcccaaactcctacgggaggcagcagtggggaatattggacaatgggggcaaccctgatccagcaatgccgcgtgggtgaagaaggttttcggattgtaaagcccttttggcggggacgatgatgacggtacccgcagaataagctccggctaacttcgtgccagcagccgcggtaatacgaagggggctagcgttgctcggaatgactgggcgtaaagggcgcgtaggcggcttacatagttaggcgtgaaattcctgggctcaacctggggactgcgtctaatacatgtaggcttgagtgtgaaagagggtcgtggaatttccagtgtagaggtgaaattcgtagatattggaaagaacaccggtggcgaaggcggcgacctggttcattactgacgctgaggcgcgaaagcgtggggagcaaacaggattagataccctggtagtccacgctgtaaacgatgtgtgctggatgttggggtgcttagcacttcagtgtcgtagctaacgcggtaagcacaccgcctggggagtacggccgcaaggttgaaactcaaaggaattgacgggggcccgcacaagcggtggagcatgtggtttaattcgaagcaacgcgcagaaccttaccaggatttgacatggaagagacgtgcccagagatgggtattcccgcaagggctctttgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgtcctgggctacacacgtgctacaatggcggtgacagtgggaagccaagcagcgatgctgagctgatcctgaaaagccgtctcagttcggattgcactctgcaactcgggtgcatgaaggtggaatcgctagtaatcgcggatcagcatgccgcggtgaatacgttcccgggccttgtacacaccgcccgtcacaccatgggatttggtttgaccttaagttgatgcgctaaccgcaaggaggcagtcaaccacggtcgggtcagagactggggtgaagtcgtaacaaggtagccgtaggggaacctgcggctggatcacctcctttcaag

SEQ ID NO: 988 - DNA, 1497 bp, Acidiphilium cryptum
  ref <308>: DATABASE ACCESSION NUMBER: NCBI ACCESSION: NC_009484.1
  ref <309>: DATABASE ENTRY DATE: 2019-04-01
  ref <313>: RELEVANT RESIDUES IN SEQ ID NO: (1)..(1497)
atgaacttgagagtttgatcctggctcagagcgaacgctggcggcatgcttaacacatgcaagtcgcacgggcagggcaacctgtcagtggcggacgggtgagtaacgcgtaggaatctatccttgggtgggggacaaccgtgggaaactacggctaataccgcatgatccctgaggggcaaaggcgaaagtcgcctgaggaggagcctgcgtctgattaggtagttggtggggtaaaggcctaccaagcctgcgatcagtagctggtctgagaggatgatcagccacactgggactgagacacggcccagactcctacgggaggcagcagtggggaatattggacaatgggcgaaagcctgatccagcaatgccgcgtggatgaagaaggtcttcggattgtaaagtccttttggcggggacgatgatgacggtacccgcagaataagctccggctaacttcgtgccagcagccgcggtaatacgaagggggctagcgttgctcggaatgactgggcgtaaagggcgcgtaggcggacggcacagtcaggcgtgaaattcctgggctcaacctggggactgcgtctgagacgtgttgtcttgagtatggaagagggttgtggaatttccagtgtagaggtgaaattcgtagatattggaaagaacaccggtggcgaaggcggcaacctggtccattactgacgctgaggcgcgaaagcgtggggagcaaacaggattagataccctggtagtccacgctgtaaacgatgtgtgctggatgttggggtgcttagcacttcagtgtcgtagctaacgcggtaagcacaccgcctggggagtacggccgcaaggttgaaactcaaaggaattgacgggggcccgcacaagcggtggagcatgtggtttaattcgaagcaacgcgcagaaccttaccaggatttgacatggggagtaccggtccagagatggactttcccgcaaggggctcccgcacaggtgctgcatggctgtcgtcagctcgtgtcgtgagatgttgggttaagtcccgcaacgagcgcaaccctcgccttcagttgccagcatgtttgggtgggcactctgaaggaactgccggtgacaagccggaggaaggtggggatgacgtcaagtcctcatggcccttatgtcctgggctacacacgtgctacaatggcggtgacagtgggaagccaggtggtgacaccgagctgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggatttggtttgaccttaagttggtgcgctaacccgcaagggaggcagccaaccacggtcgggtcagagactggggtgaagtcgtaacaaggtagccgtaggggaacctgcggctggatcacctcctttcaag

SEQ ID NO: 989 - DNA, 1497 bp, Acidiphilium multivorum
  ref <308>: DATABASE ACCESSION NUMBER: NCBI ACCESSION: NZ_BANA01000242.1
  ref <309>: DATABASE ENTRY DATE: 2019-04-01
  ref <313>: RELEVANT RESIDUES IN SEQ ID NO: (1)..(1497)
atgaacttgagagtttgatcctggctcagagcgaacgctggcggcatgcttaacacatgcaagtcgcacgggcagggcaacctgtcagtggcggacgggtgagtaacgcgtaggaatctatccttgggtgggggacaaccgtgggaaactacggctaataccgcatgatccctgaggggcaaaggcgaaagtcgcctggggaggagcctgcgtctgattaggtagttggtggggtaaaggcctaccaagcctgcgatcagtagctggtctgagaggatgatcagccacactgggactgagacacggcccagactcctacgggaggcagcagtggggaatattggacaatgggcgaaagcctgatccagcaatgccgcgtggatgaagaaggtcttcggattgtaaagtccttttggcggggacgatgatgacggtacccgcagaataagctccggctaacttcgtgccagcagccgcggtaatacgaagggggctagcgttgctcggaatgactgggcgtaaagggcgcgtaggcggacggcacagtcaggcgtgaaattcctgggctcaacctggggactgcgtctgagacgtgttgtcttgagtatggaagagggttgtggaatttccagtgtagaggtgaaattcgtagatattggaaagaacaccggtggcgaaggcggcaacctggtccattactgacgctgaggcgcgaaagcgtggggagcaaacaggattagataccctggtagtccacgctgtaaacgatgtgtgctggatgttggggtgcttagcacttcagtgtcgtagctaacgcggtaagcacaccgcctggggagtacggccgcaaggttgaaactcaaaggaattgacgggggcccgcacaagcggtggagcatgtggtttaattcgaagcaacgcgcagaaccttaccaggatttgacatggggagtaccggtccagagatggactttcccgcaaggggctcccgcacaggtgctgcatggctgtcgtcagctcgtgtcgtgagatgttgggttaagtcccgcaacgagcgcaaccctcgccttcagttgccagcatgtttgggtgggcactctgaaggaactgccggtgacaagccggaggaaggtggggatgacgtcaagtcctcatggcccttatgtcctgggctacacacgtgctacaatggcggtgacagtgggaagccaggtggtgacaccgagctgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggatttggtttgaccttaagttggtgcgctaacccgcaagggaggcagccaaccacggtcgggtcagagactggggtgaagtcgtaacaaggtagccgtaggggaacctgcggctggatcacctcctttcaag

SEQ ID NO: 990 - DNA, 1497 bp, Acidiphilium rubrum; identical to SEQ ID NO: 987
  ref <308>: DATABASE ACCESSION NUMBER: NCBI ACCESSION: NZ_FTNE01000060.1
  ref <309>: DATABASE ENTRY DATE: 2019-04-01
  ref <313>: RELEVANT RESIDUES IN SEQ ID NO: (1)..(1497)

SEQ ID NO: 991 - DNA, 1497 bp, Acidiphilium sp. JA12-A1
  ref <308>: DATABASE ACCESSION NUMBER: NCBI ACCESSION: NZ_JFHO01000234.1
  ref <309>: DATABASE ENTRY DATE: 2019-04-01
  ref <313>: RELEVANT RESIDUES IN SEQ ID NO: (1)..(1497)
atgaacttgagagtttgatcctggctcagagcgaacgctggcggcatgcttaacacatgcaagtcgcacgggcagggcaacctgtcagtggcggacgggtgagtaacgcgtaggaatctatccttgggtgggggacaaccgtgggaaactacggctaataccgcatgatccctgaggggcaaaggcgaaagtcgcctaaggaggagcctgcgtctgattaggtagttggtggggtaaaggcctaccaagcctgcgatcagtagctggtctgagaggatgatcagccacactgggactgagacacggcccagactcctacgggaggcagcagtggggaatattggacaatgggcgaaagcctgatccagcaatgccgcgtggatgaagaaggtcttcggattgtaaagtccttttggcggggacgatgatgacggtacccgcagaataagctccggctaacttcgtgccagcagccgcggtaatacgaagggggctagcgttgctcggaatgactgggcgtaaagggcgcgtaggcggacggcacagtcaggcgtgaaattcctgggctcaacctggggactgcgtctgagacgtgttgtcttgagtatggaagagggttgtggaatttccagtgtagaggtgaaattcgtagatattggaaagaacaccggtggcgaaggcggcaacctggtccattactgacgctgaggcgcgaaagcgtggggagcaaacaggattagataccctggtagtccacgctgtaaacgatgtgtgctggatgttggggtgcttagcacttcagtgtcgtagctaacgcggtaagcacaccgcctggggagtacggccgcaaggttgaaactcaaaggaattgacgggggcccgcacaagcggtggagcatgtggtttaattcgaagcaacgcgcagaaccttaccaggatttgacatggggagtaccggtccagagatggactttcccgcaaggggctcccgcacaggtgctgcatggctgtcgtcagctcgtgtcgtgagatgttgggttaagtcccgcaacgagcgcaaccctcgccttcagttgccagcatgtttgggtgggcactctgaaggaactgccggtgacaagccggaggaaggtggggatgacgtcaagtcctcatggcccttatgtcctgggctacacacgtgctacaatggcggtgacagtgggaagccaggtggtgacaccgagctgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggatttggtttgaccttaagttggtgcgctaacccgcaagggaggcagccaaccacggtcgggtcagagactggggtgaagtcgtaacaaggtagccgtaggggaacctgcggctggatcacctcctttcaag

SEQ ID NO: 992 - DNA, 1497 bp, Acidiphilium sp. PM; identical to SEQ ID NO: 988
  ref <308>: DATABASE ACCESSION NUMBER: NCBI ACCESSION: NZ_AFPR01000512.1
  ref <309>: DATABASE ENTRY DATE: 2019-04-01
  ref <313>: RELEVANT RESIDUES IN SEQ ID NO: (1)..(1497)

SEQ ID NO: 993 - DNA, 1497 bp, Acidipila dinghuensis
  ref <308>: DATABASE ACCESSION NUMBER: NCBI ACCESSION: NZ_SDMK01000001.1
  ref <309>: DATABASE ENTRY DATE: 2019-04-01
  ref <313>: RELEVANT RESIDUES IN SEQ ID NO: (1)..(1497)
gagagtttgatcctggctcagaatcaacgctggcggcgtgcctaacacatgcaagtcgaacgagaaagggacttcggtcctgagtaaagtggcgcacgggtgagtaacacgtgactaacctacccttgagtggggaataactaggagaaatcttagctaataccgcataacacctacgggtcaaaggagcaattcgcttaaggagggggtcgcggcagattagttagttggcggggtaatggcccaccaagacagtgatctgtatccggcctgagagggcgcacggacacactggaactgaaacacggtccagactcctacgggaggcagcagtggggaattttgcgcaatgggggaaaccctgacgcagcaacgccgcgtggaggatgaagtcctttgggacgtaaactcctttcgatcgggacgattatgacggtaccgagagaagaagccccggctaacttcgtgccagcagccgcggtaatacgaggggggcgagcgttgttcggaattattgggcgtaaagggtgcgtaggcggttcggtaagtcttgtgtgaaatcttcgggctcaactcgaagtctgcactcgaaactgccgggcttgagtatgggagaggtgagtggaatttccggtgtagcggtgaaatgcgtagatatcggaaggaacacctgtggcgaaagcggctcactggaccataactgacgctgatgcacgaaagctaggggagcaaacaggattagataccctggtagtcctagccctaaacgatgatcgcttggtgtgacgggtacccaatcccgccgtgccgaagctaacgcgttaagcgatccgcctggggagtacggtcgcaaggctgaaactcaaaggaattgacgggggcccgcacaagcggtggagcatgtggtttaattcgacgcaacgcgaagaaccttacctgggctcgaaatgtagaggaatccggtggaaacatcggcgcctagcaataggcctctatataggtgctgcatggctgtcgtcagctcgtgtcgtgagatgttgggttaagtcccgcaacgagcgcaacccttattaccagttgctaccatttagttgagcactctggtgagaccgcctcggataacggggaggaaggcggggatgacgtcaagtcctcatggcctttatgtccagggctacacacgtgctacaatggtcggtacaaaccgtcgcaaacccgcgagggggagctaatcggaaaaagccgacctcagttcggattacagtctgcaactcgactgtatgaagctggaatcgctagtaatcgcggatcagaatgccgcggtgaatacgttcccgggccttgtacacaccgcccgtcacatcacgaaagtgggttgcactagaagcaggtgagccaaccgcaagggggcagccttccaaggtgtaattcatgattggggtgaagtcgtaacaaggtagccgtaggagaacctgcggctggatcacctcctttcta

SEQ ID NO: 994 - DNA, 1499 bp, Acidipila sp. 4G-K13
  ref <308>: DATABASE ACCESSION NUMBER: NCBI ACCESSION: NZ_QVQT01000003.1
  ref <309>: DATABASE ENTRY DATE: 2019-04-01
  ref <313>: RELEVANT RESIDUES IN SEQ ID NO: (1)..(1499)
gagagtttgatcctggctcagaatcaacgctggcggcgtgcctaacacatgcaagtcgaacgagaaagtggagcaatccatgagtaaagtggcgcacgggtgagtaacacgtgactaacctgcccttgagtggggaataacctggggaaaccttggctaataccgcataacacctacgggtcaaaggagcaattcgcttaaggagggggtcgcggccgattagttagttggcggggtaatggcccaccaagacgatgatcggtatccggcctgagagggcgcacggacacactggaactgagacacggtccagactcctacgggaggcagcagtggggaattttgcgcaatgggggaaaccctgacgcagcaacgccgcgtggaggatgaagtcccttgggacgtaaactcctttcgatcgggacgattatgacggtaccggaagaagaagccccggctaacttcgtgccagcagccgcggtaatacgaggggggcgagcgttgttcggaattattgggcgtaaagggtgcgtaggcggttcggtaagtcttgtgtgaaatcttcgggctcaactcgaagtctgcaccagaaactgccgggcttgagtgtgggagaggtgagtggaatttccggtgtagcggtgaaatgcgtagatatcggaaggaacacctgtggcgaaagcggctcactggaccacaactgacgctgaggcacgaaagctgggggagcaaacaggattagataccctggtagtcccagccctaaacgatgatcgcttggtgtgacgggtacccaatcccgccgtgccgtagctaacgcgttaagcgatccgcctggggagtacggtcgcaaggctgaaactcaaaggaattgacgggggcccgcacaagcggtggagcatgtggtttaattcgacgcaacgcgaagaaccttacctgggctcgaaatgtacaggaatgcggtagaaatatcgccgtccagcaatggacctgtatataggtgctgcatggctgtcgtcagctcgtgtcgtgagatgttgggttaagtcccgcaacgagcgcaacccttattaccagttgctaccatttagttgagcactctggtgagaccgcctcggataacggggaggaaggcggggatgacgtcaagtcctcatggcctttatgtccagggctacacacgtgctacaatggccggtacaaaccgtcgcaaacccgtgagggggagctaatcggaaaaagccggcctcagttcggattggagtctgcaactcgactccatgaagctggaatcgctagtaatcgcggatcagaacgccgcggtgaatacgttcccgggccttgtacacaccgcccgtcacatcacgaaagtgggttgtactagaagcaggtgcgccaaccgcaaggaggcagccttccaaggtgtaattcatgattggggtgaagtcgtaacaaggtagccgtaggagaacctgcggctggatcacctcctttctaag

SEQ ID NO: 995 - DNA, 1499 bp, Acidipila sp. EB88
  ref <308>: DATABASE ACCESSION NUMBER: NCBI ACCESSION: NZ_QWEV01000005.1
  ref <309>: DATABASE ENTRY DATE: 2019-04-01
  ref <313>: RELEVANT RESIDUES IN SEQ ID NO: (1)..(1499)
gagagtttgatcctggctcagaatcaacgctggcggcgtgcctaacacatgcaagtcgaacgagaaagggacttcggtcctgagtaaagtggcgcacgggtgagtaacacgtgactaacctaccctggagtggggaataacttcgagaaatcgaggctaattccgcataatacctacgggtcaaaggagcaattcgctctgggagggggtcgcggcagattagctagttggcggggtaatggcccaccaaggcagtgatctgtatccggcctgagagggcgcacggacacactggaactgaaacacggtccagactcctacgggaggcagcagtggggaattttgcgcaatgggggaaaccctgacgcagcaacgccgcgtggaggatgaagtctcttgggacgtaaactcctttcgatcgggacgataatgacggtaccgatagaagaagccccggctaacttcgtgccagcagccgcggtaatacgaggggggcaagcgttgttcggaattattgggcgtaaagggtgcgtaggcggccccgcaagtcctgtgtgaaatctacaagcttaacttgtagcctgcacgggaaactgctgggctggagtatgggagaggtgagtggaattcctggtgtagcggtgaaatgcgtagatatcaggaggaacacctgtggcgaaagcggctcactggaccataactgacgctgaggcacgaaagctaggggagcaaacaggattagataccctggtagtcctagccctaaacgatgatcgcttggtgtggcgggtacccaatcccgtcgtgccgtagctaacgcgttaagcgatccgcctggggagtacggtcgcaaggctgaaactcaaaggaattgacgggggcccgcacaagcggtggagcatgtggtttaattcgacgcaacgcgaagaaccttacctgggctcgaaatgtacaggaatccgtcggaaacggcggcgtctcgcaagagacctgtatataggtgctgcatggctgtcgtcagctcgtgtcgtgagatgttgggttaagtcccgcaacgagcgcaacccttgctaccagttgctaccatttagttgagcactctggtgggaccgcctcggataacggggaggaaggcggggatgacgtcaagtcctcatggcctttatgtccagggctacacacgtgctacaatggccggtacaaaccgttgcaaccctgcgaaggtgagctaatcggaaaaagccggcctcagttcggattggagtctgcaactcgactccatgaagctggaatcgctagtaatcgcggatcagcatgccgcggtgaatacgttcccgggccttgtacacaccgcccgtcacatcacgaaagtgggttgtactagaagccggtgagccgacccgcaaggggggcagccgtccaaggtgtaattcatgattggggtgaagtcgtaacaaggtagccgtaggagaacctgcggctggatcacctcctttcta

SEQ ID NO: 996 - DNA, 1545 bp, Acidipropionibacterium acidipropionici
  ref <308>: DATABASE ACCESSION NUMBER: NCBI ACCESSION: NZ_CP031057.1
  ref <309>: DATABASE ENTRY DATE: 2019-04-01
  ref <313>: RELEVANT RESIDUES IN SEQ ID NO: (1)..(1545)
ttttcattggagagtttgatcctggctcaggacgaacgctggcggcgtgcttaacacatgcaagtcgaacggtaaggccctttcgggggtacacgagtggcgaacgggtgagtaacacgtgagtaacctgcccacttcttcgggataacgctaggaaactggtgctaataccggatatgagctcctgccgcatggtgggggttggaaagtgtttgtggtggtggatggactcgcggcctatcagcttgttggtgaggtagtggctcaccaaggcggtgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcaccaggggcgaaggcattcttttggggtgttgacggtacctggagaagaagcaccggctaactacgtgccagcagccgcggtgatacgtagggtgcgagcgttgtccggatttattgggcgtaaagggctcgtaggcggttgatcgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcaaacaggcttagataccctggtagtccacgctgtaaacggtgggtactaggtgtggggtccattccacggattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggattggtaacggtcagagatggccgccccccttgtgggccggttcacaggtggtgcatggctgtcgtcagctcgtgtcgtgagatgttgggttaagtcccgcaacgagcgcaaccctcgtccactgttgccagcatttggttggggactcagtggagaccgccggggtcaactcggaggaaggtggggatgacgtcaagtcatcatgccccttatgtccagggcttcacgcatgctacaatggccggtacaaagagtggcgacatcgtgaggtggagcgaatctcagaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaacacgttctgcgtgggggagtcgtcgaaggtgggactggtaattaggactaagtcgtaacaaggtagccgtaccggaaggtgcggctggatcacctcctttctaaggag

SEQ ID NO: 997 - DNA, 1540 bp, Acidipropionibacterium jensenii
  ref <308>: DATABASE ACCESSION NUMBER: NCBI ACCESSION: NZ_LR134473.1
  ref <309>: DATABASE ENTRY DATE: 2019-04-01
  ref <313>: RELEVANT RESIDUES IN SEQ ID NO: (1)..(1540)
ttttcattggagagtttgatcctggctcaggacgaacgctggcggcgtgcttaacacatgcaagtcgaacggtaaggccctttcgggggtacacgagtggcgaacgggtgagtaacacgtgagtaacctgcccatcacttcgggataacgctaggaaactggtgctaataccggatatgagctctcatcgcatggtgggggttggaaagttctggcggtggtggatggactcgcgtcctatcagcttgttggtgaggttgtggctcaccaaggcgtcgacgggtagccggcctgagagggtgaccggccacattgggactgagatacggcccagactcctacgggaggcagcagtggggaatattgcacaatgggcgcaagcctgatgcagcaacgccgcgtgcgggatgacggccttcgggttgtaaaccgctttcaccagggacgaagtgcctttcggggtgtgacggtacctggagaagaagcaccggctaactacgtgccagcagccgcggtgatacgtagggtgcgagcgttgtccggatttattgggcgtaaagagctcgtaggtggttgatcacgtcggaagtgaaaacttggggcttaaccctgggcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcaaacaggcttagataccctggtagtccacgctgtaaacggtgggtactaggtgtggggtccattccacggattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggattggtaacggtcagagatggccgccccccttgtgggccgattcacaggtggtgcatggctgtcgtcagctcgtgtcgtgagatgttgggttaagtcccgcaacgagcgcaaccctcgtccactgttgccagcaattcggttggggactcagtggagaccgccggggtcaactcggaggaaggtggggatgacgtcaagtcatcatgccccttatgtccagggcttcacgcatgctacaatggctggtacaaagagttgcgacactgtgaggtggagcgaatctcaaaaagccagtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaaccttttggggggggagccgtcgaaggtgggactggtaattaggactaagtcgtaacaaggtagccgtaccggaaggtgcggctggatcacctcctttctaaggag

SEQ ID NO: 998 - DNA, 1539 bp, Acidipropionibacterium virtanenii
  ref <308>: DATABASE ACCESSION NUMBER: NCBI ACCESSION: NZ_CP025198.1
  ref <309>: DATABASE ENTRY DATE: 2019-04-01
  ref <313>: RELEVANT RESIDUES IN SEQ ID NO: (1)..(1539)
ttttcattggagagtttgatcctggctcaggacgaacgctggcggcgtgcttaacacatgcaagtcgaacggtaaggcctcttcgggggtacacgagtggcgaacgggtgagtaacacgtgagtaacctgcccttcacttcgggataacgctaggaaactggtgctaataccggatatgagctctcatcgcatggtgggggttggaaaattgtggtggtggtggatggactcgcggcctatcagcttgttggtgaggtagtggctcaccaaggcggtgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcaccagggacgaaggtgcctttcggggtgttgacggtacctggagaagaagcaccggctaactacgtgccagcagccgcggtgatacgtagggtgcgagcgttgtccggatttattgggcgtaaagggctcgtaggcggttgatcacgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcaaacaggcttagataccctggtagtccacgctgtaaacggtgggtactaggtgtggggtccattccacggattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggattggtaacggtcagagatggccgccccccttgtgggccggttcacaggtggtgcatggctgtcgtcagctcgtgtcgtgagatgttgggttaagtcccgcaacgagcgcaaccctcgtccactgttgccagcatttggttggggactcagtggagaccgccggggtcaactcggaggaaggtggggatgacgtcaagtcatcatgccccttatgtccagggcttcacgcatgctacaatggccggtacaaagagtggcgacatcgtgaggtggagcgaatctcaaaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaacacgtgagtgggggagtcgtcgaaggtgggactggtaattaggactaagtcgtaacaaggtagccgtaccggaaggtgcggctggatcacctcctttctaagg

SEQ ID NO: 999 - DNA, 1495 bp, Acidisphaera rubrifaciens
  ref <308>: DATABASE ACCESSION NUMBER: NCBI ACCESSION: NZ_BANB01000583.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacggccgggcaaccggcagtggcggacgggtgagtaacgcgtaggtatctatccacgggtgggggataactgtgggaaactacagctaataccgcatgacaccttcgggtcaaaggcgcgagtcgcctgtggaggagcctgcgtccgattagctagttggtggggtaaaggcctaccaaggcgacgatcggtagctggtctgagaggatgatcagccacactgggactgagacacggcccagactcctacgggaggcagcagtggggaatattggacaatgggcgaaagcctgatccagcaatgccgcgtgggtgaagaaggtcttcggattgtaaagccctttcggcggggacgatgatgacggtacccgcagaagaagccccggctaacttcgtgccagcagccgcggtaatacgaagggggctagcgttgctcggaatgactgggcgtaaagggcgcgtaggcggttgatacagtcaggcgtgaaattcctgggcttaacctgggggctgcgcttgatacgtattggcttgagtggggaagagggtcgtggaattcccagtgtagaggtgaaattcgtagatattgggaagaacaccggtggcgaaggcggcgacctggtccttgactgacgctgaggcgcgaaagcgtggggagcaaacaggattagataccctggtagtccacgccgtaaacgatgtgcgctggatgttgggtggcctagccactcagtgtcgtagctaacgcgataagcgcaccgcctggggagtacggccgcaaggttgaaactcaaaggaattgacgggggcccgcacaagcggtggagcatgtggtttaattcgaagcaacgcgcagaaccttaccagggcttgacatggggtcgtcatgtccagagatgggcattcccgcaagggcgacctgcacaggtgctgcatggctgtcgtcagctcgtgtcgtgagatgttgggttaagtcccgcaacgagcgcaaccctcgccttcagttgccatcaggtttggctgggcactctgaaggaactgccggtgacaagccggaggaaggtggggatgacgtcaagtcctcatggcccttatgtcctgggctacacacgtgctacaatggcggtgacagtgggaagccaggcagcgatgccgagctgatcccaaaaagccgtctcagttcagattgcactctgcaactcgggtgcatgaaggtggaatcgctagtaatcgcggatcagcatgccgcggtgaatacgttcccgggccttgtacacaccgcccgtcacaccatgggagttggttcgaccttaagccggtgcgcgaactcgcaagagacgcagccgaccacggtcgggtcagcgactggggtgaagtcgtaacaaggtagccgtaggggaacctgcggctggatcacctcctttcaag

SEQ ID NO: 1000 - DNA, 1546 bp, Acidithiobacillus ferridurans
  ref <308>: DATABASE ACCESSION NUMBER: NCBI ACCESSION: NZ_AP018795.1
  ref <309>: DATABASE ENTRY DATE: 2019-04-01
  ref <313>: RELEVANT RESIDUES IN SEQ ID NO: (1)..(1546)
gattgaacttaagagtttgatcctggctcagattgaacgctggcggcatgcctaacacatgcaagtcgaacggtaacaggtcttcggatgctgacgagtggcggacgggtgagtaatgcgtaggaatctgtcttttagtgggggacaacccagggaaacttgggctaataccgcatgagccctgagggggaaagcgggggatcttcggacctcgcgctaagggaggagcctacgtctgattagctagttggtagggtaaaggcctaccaaggcgacgatcagtagctggtctgagaggacgaccagccacactgggactgagacacggcccagactcctacgggaggcagcagtggggaatttttcgcaatgggggcaaccctgacgaagcaatgccgcgtggatgaagaaggccttcgggttgtaaagtcctttcgtggaggacgaaaaggcgggttctaatacaatctgctgttgacgtgaatccaagaagaagcaccggctaactccgtgccagcagccgcggtaatacggggggtgcaagcgttaatcggaatcactgggcgtaaagggtgcgtaggcggtacgttaggtctgtcgtgaaatccccgggctcaacctgggaatggcggtggaaaccggcggactagagtatgggagagggtggtggaattccaggtgtagcggtgaaatgcgtagagatctggaggaacatcagtggcgaaggcggccacctggcccaatactgacgctgaggcacgaaagcgtggggagcaaacaggattagataccctggtagtccacgccctaaacgatgaatactagatgtttggtgccacgcgtactgagtgtcgtagctaacgcgataagtattccgcctgggaagtacggccgcaaggttaaaactcaaaggaattgacgggggcccgcacaagcggtggagcatgtggtttaattcgatgcaacgcgaagaaccttacctgggcttgacatgtccggaattctgcagagatgcgggagtgcccttcggggaatcggaacacaggtgctgcatggctgtcgtcagctcgtgtcgtgagatgttgggttaagtcccgcaacgagcgcaacccttgtccttagttgccagcggttcggccgggcactctagggagactgccggtgacaaaccggaggaaggtggggatgacgtcaagtcctcatggcctttatgtccagggctacacacgtgctacaatggcgcgtacagagggaagccaagccgcgaggtggagcagaccccagaaagcgcgtcgtagttcggattgcagtctgcaactcgactgcatgaagtcggaatcgctagtaatcgcggatcagcatgccgcggtgaatacgttcccgggccttgtacacaccgcccgtcacaccatgggagtggatggtaccagaagcagctagcctaaccttcgggagggcggttaccacggtatggttcatgactggggtgaagtcgtaacaaggtagccgtaggggaacctgcggctggatcacctcctttaaagaa

SEQ ID NO: 1001 - DNA, 1533 bp, Acidithiobacillus sp. CJ-2
  ref <308>: DATABASE ACCESSION NUMBER: NCBI ACCESSION: NZ_RIZI01000077.1
  ref <309>: DATABASE ENTRY DATE: 2019-04-01
  ref <313>: RELEVANT RESIDUES IN SEQ ID NO: (1)..(1533)
gagagtttgatcctggctcagattgaacgctggcggcatgcctaacacatgcaagtcgaacggtaacaggtcttcggatgctgacgagtggcggacgggtgagtaaagcgtaggaatctgtcttttagtgggggacaacccagggaaacttgggctaataccgcatgagccctgagggggaaagcgggggatcttcggacctcgcgctgaaagaggagcctgcgtccgattagctagttggcggggtaaaggcccaccaaggcgacgatcggtagctggtctgagaggacgaccagccacactgggactgagacacggcccagactcctacgggaggcagcagtggggaatttttcgcaatgggggcaaccctgacgaagcaatgccgcgtggatgaagaaggccttcgggttgtaaagtcctttcgtgggggacgaaaaggtgggtcctaatagggtctgctgttgacgtgaacccaagaagaagcaccggctaactccgtgccagcagccgcggtaatacggagggtgcaagcgttaatcggaattactgggcgtaaagggcgcgtaggcggttggttacgtctgccgtgaaatccccgggctcaacctgggaatggcggtggaaacgggcggactagagtatgggagagggtgatggaattccaggtgtagcggtgaaatgcgtagagatctggaggaacatcagtggcgaaggcggtcacctggcccaatactgacgctgaggcgcgaaagcgtggggagcaaacaggattagataccctggtagtccacgccctaaacgatgaatactagatgtttggtgcttaacgtgctgagtgtcgtagctaacgcgataagtattccgcctgggaagtacggccgcaaggttaaaactcaaaggaattgacgggggcccgcacaagcggtggagcatgtggtttaattcgatgcaacgcgaagaaccttacctgggcttgacatgtccggaatcctgcagagatgtgggagtgcccttcggggaatcggaacacaggtgctgcatggctgtcgtcagctcgtgtcgtgagatgttgggttaagtcccgcaacgagcgcaacccttgtctttagttgccagcggttcggccgggcactctagagagactgccggtgacaaaccggaggaaggtggggatgacgtcaagtcctcatggcctttatgtccagggctacacacgtgctacaatggcgcgtacagagggaagccaacccgcgagggggagcagaccccagaaagcgcgccgtagttcggattgcagtctgcaactcgactgcatgaagtcggaatcgctagtaatcgcggatcagcatgccgcggtgaatacgttcccgggccttgtacacaccgcccgtcacaccatgggagtagattgtaccagaagcggctagctcaaccttcgggagggcggtcaccacggtatggtttatgactggggtgaagtcgtaacaaggtagccgtaggggaacctgcggctggatcacctcctttaaa

SEQ ID NO: 1002 - DNA, 1491 bp, Acidocella aminolytica
  ref <308>: DATABASE ACCESSION NUMBER: NCBI ACCESSION: NZ_FQVJ01000072.1
  ref <309>: DATABASE ENTRY DATE: 2019-04-01
  ref <313>: RELEVANT RESIDUES IN SEQ ID NO: (1)..(1491)
atgaacttgagagtttgatcctggctcagagcgaacgctggcggcatgcttaacacatgcaagtcgcacggtcagcaatggcagtggcggacgggtgagtaacacgtaggaatctatccagaggtgggggacaacagcgggaaactgctgctaataccgcatgatacctgagggtcaaaggcgcaagtcgcctttggaggagcctgcgtctgattagcttgttggtggggtaaaggcttaccaaggcgacgatcagtagctggtctgagaggatgatcagccacattgggactgagacacggcccaaactcctacgggaggcagcagtggggaatattggacaatgggcgcaagcctgatccagcaatgccgcgtgtgtgaagaaggtcttcggattgtaaagcacttttggcagggacgatgatgacggtacctgcagaataagccccggctaacttcgtgccagcagccgcggtaatacgaagggggctagcgttgctcggaatgactgggcgtaaagggcgtgtaggcggcatgtacagtcagaagtgaaattcctgggctcaacctggggactgcttttgatacgtgcaagcttgagtgaggaagagggttgtggaatttccagtgtagaggtgaaattcgtagatattggaaagaacaccggtggcgaaggcggcaacctggtcctttactgacgctgaggcgcgaaagcgtggggagcaaacaggattagataccctggtagtccacgctgtaaacgatgtgtgctggatgttgggaaacttagtttttcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccaggatttgacatggggaggcttggtacagagatgtatctttcccgcaagggaccttccgcacaggtgctgcatggctgtcgtcagctcgtgtcgtgagatgttgggttaagtcccgcaacgagcgcaaccctcgcctttagttgccatcatttagttgggcactctaaaggaactgccggtgacaagccggaggaaggtggggatgacgtcaagtcctcatggcccttatgtcctgggctacacacgtgctacaatggtggtgacagtgggaagctaggcggtgacgccgtgctgatctctaaaagccatctcagttcggattgtactctgcaactcgagtacatgaaggtggaatcgctagtaatcgtggatcagcatgccacggtgaatacgttcccgggccttgtacacaccgcccgtcacaccatgggatttggtttgaccttaagcaggtgcgctaaccgcaaggaggcagcctaccacggtcgggtcagagactggggtgaagtcgtaacaaggtagccgtaggggaacctgcggctggatcacctcctttcaag

SEQ ID NO: 1003 - DNA, 1306 bp, Acidocella facilis
  ref <308>: DATABASE ACCESSION NUMBER: NCBI ACCESSION: NZ_JHYG01000046.1
  ref <309>: DATABASE ENTRY DATE: 2019-04-01
  ref <313>: RELEVANT RESIDUES IN SEQ ID NO: (1)..(1306)
agtcgccttgggaggagcctgcgtctgattagcttgttggtggggtaaaggcctaccaaggcgacgatcagtagctggtctgagaggatgatcagccacattgggactgagacacggcccaaactcctacgggaggcagcagtggggaatattggacaatgggcgcaagcctgatccagcaatgccgcgtgtgtgaagaaggtcttcggattgtaaagcacttttggcagggacgatgatgacggtacctgcagaataagccccggctaacttcgtgccagcagccgcggtaatacgaagggggctagcgttgctcggaatgactgggcgtaaagggcgcgtaggcggcatgtacagtcagaagtgaaattcctgggctcaacctggggactgcttttgatacgtgcaagctagagtgaggaagagggttgtggaatttccagtgtagaggtgaaattcgtagatattggaaagaacaccggtggcgaaggcggcaacctggtccttaactgacgctgaggcgcgaaagcgtggggagcaaacaggattagataccctggtagtccacgctgtaaacgatgtgtgctggatgttggggaacttagtttctcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccaggatttgacatggggaggaccggtacagagatgtacttttcccgcaagggaccttccgcacaggtgctgcatggctgtcgtcagctcgtgtcgtgagatgttgggttaagtcccgcaacgagcgcaacccttgcctttagttgccatcatttagttgggcactctagaggaactgccggtgacaagccggaggaaggtggggatgacgtcaagtcctcatggcccttatgtcctgggctacacacgtgctacaatggtggtgacagtgggaagctaggtagtgataccgtgctgatctctaaaagccatctcagttcagattgtactctgcaactcgagtacatgaaggtggaatcgctagtaatcgtggatcagcatgccacggtgaatacgttcccgggccttgtacacaccgcccgtcacaccatgggatttggtttgaccttaagtaggtgcgctaaccgcaaggaggtagcctaccacggtcgggtcagagactggggtgaagtcgtaacaaggtagccgtaggggaacctgcggctggatcacctcctttcaag

SEQ ID NO: 1004 - DNA, 1491 bp, Acidocella sp. MX-AZ02
  ref <308>: DATABASE ACCESSION NUMBER: NCBI ACCESSION: NZ_JH976209.1
  ref <309>: DATABASE ENTRY DATE: 2019-04-01
  ref <313>: RELEVANT RESIDUES IN SEQ ID NO: (1)..(1491)
atgaacttgagagtttgatcctggctcagagcgaacgctggcggcatgcttaacacatgcaagtcgcgcggtcagcaatggcagcggcggacgggtgagtaacacgtaggaatctatcccagggtgggggacaacagcgggaaactgctgctaataccgcatgatacctgagggtcaaaggcgcaagtcgccttgggaggagcctgcgtctgattagcttgttggtggggtaaaggcctaccaaggcgacgatcagtagctggtctgagaggatgatcagccacattgggactgagacacggcccaaactcctacgggaggcagcagtggggaatattggacaatgggcgcaagcctgatccagcaatgccgcgtgtgtgaagaaggtcttcggattgtaaagcacttttggcagggacgatgatgacggtacctgcagaataagccccggctaacttcgtgccagcagccgcggtaatacgaagggggctagcgttgctcggaatgactgggcgtaaagggcgcgtaggcggcatgtacagtcagaagtgaaattcctgggctcaacctggggactgcttttgatacgtgcaagctagagtgaggaagagggttgtggaatttccagtgtagaggtgaaattcgtagatattggaaagaacaccggtggcgaaggcggcaacctggtccttaactgacgctgaggcgcgaaagcgtggggagcaaacaggattagataccctggtagtccacgctgtaaacgatgtgtgctggatgttggggaacttagtttctcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccaggatttgacatggggaggaccggtacagagatgtacttttcccgcaagggaccttccgcacaggtgctgcatggctgtcgtcagctcgtgtcgtgagatgttgggttaagtcccgcaacgagcgcaacccttgcctttagttgccatcatttagttgggcactctagaggaactgccggtgacaagccggaggaaggtggggatgacgtcaagtcctcatggcccttatgtcctgggctacacacgtgctacaatggtggtgacagtgggaagctaggtagtgataccgtgctgatctctaaaagccatctcagttcagattgtactctgcaactcgagtacatgaaggtggaatcgctagtaatcgtggatcagcatgccacggtgaatacgttcccgggccttgtacacaccgcccgtcacaccatgggatttggtttgaccttaagtaggtgcgctaaccgcaaggaggtagcctaccacggtcgggtcagagactggggtgaagtcgtaacaaggtagccgtaggggaacctgcggctggatcacctcctttcaag

SEQ ID NO: 1005 - DNA, 1497 bp, Acidomonas methanolica
  ref <308>: DATABASE ACCESSION NUMBER: NCBI ACCESSION: NZ_BAND01000318.1
  ref <309>: DATABASE ENTRY DATE: 2019-04-01
  ref <313>: RELEVANT RESIDUES IN SEQ ID NO: (1)..(1497)
attgaatttgagagtttgatcctggctcagagcgaacgctggcggcatgcttaacacatgcaagtcgcacgagggtttcggccctagtggcggacgggtgagtagcgcgtagggatctatccatgggtgggggataacactgggaaactggtgctaataccgcatgatgcctgagggccaaaggcgcgagtcgcctgtggaggagcctgcgttcgattagcttgttggtggggtaaaggcctaccaaggcgatgatcgatagctggtctgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggttgacacagtcagatgtgaaattccagggcttaaccttggggctgcatttgagacgtgttgactggagttcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttgggtgactttgtcattcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgacatggggaggctgtgtccagagatgggcatttcccgcaagggacctcctgcacaggtgctgcatggctgtcgtcagctcgtgtcgtgagatgttgggttaagtcccgcaacgagcgcaacccttgcctttagttgccagcatgatcgggtgggcactctagaggaactgccggtgacaagccggaggaaggtggggatgacgtcaagtcctcatggcccttatgtcctgggctacacacgtgctacaatggcggtgacagtgggaagccaggcagtgatgctgagctgatctcaaaaagccgtctcagttcggattgcactctgcaactcgggtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcaggtcagcgactggggtgaagtcgtaacaaggtagccgtaggggaacctgcggctggatcacctcctttcaagg

SEQ ID NO: 1006 - DNA, 998 bp, Acidovorax cavernicola
  ref <308>: DATABASE ACCESSION NUMBER: NCBI ACCESSION: NZ_QXMN01000195.1
  ref <309>: DATABASE ENTRY DATE: 2019-04-01
  ref <313>: RELEVANT RESIDUES IN SEQ ID NO: (1)..(998)
gaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaacggtcttttctaatacagaaggctaatgacggtaccgtaagaataagcaccggctaactacgtgccagcagccgcggtaatacgtagggtgcaagcgttaatcggaattactgggcgtaaagcgtgcgcaggcggttatgtaagacagttgtgaaatccccgggctcaacctgggaactgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaa

SEQ ID NO: 1007 - DNA, 1541 bp, Acidovorax radicis
  ref <308>: DATABASE ACCESSION NUMBER: NCBI ACCESSION: NZ_AFBH01000032.1
  ref <309>: DATABASE ENTRY DATE: 2019-04-01
  ref <313>: RELEVANT RESIDUES IN SEQ ID NO: (1)..(1541)
agatcgaactgtagagtttgatcctggctcagattgaacgctggcggcatgccttacacatgcaagtcgaacggtaacaggtcttcggatgctgacgagtggcgaacgggtgagtaatacatcggaacgtgcccgatcgtgggggataacggagcgaaagctttgctaataccgcatacgatctacggatgaaagcaggggaccgcaaggccttgcgcggacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaaagactctggttaatacctggggtccatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggatggtacaaagggtcgccaacccgcgagggggagccaatcccataaagccattcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 1008 - DNA, 1541 bp, Acidovorax sp. 100
  ref <308>: DATABASE ACCESSION NUMBER: NCBI ACCESSION: NZ_REFD01000001.1
  ref <309>: DATABASE ENTRY DATE: 2019-04-01
  ref <313>: RELEVANT RESIDUES IN SEQ ID NO: (1)..(1541)
agatcgaactgtagagtttgatcctggctcagattgaacgctggcggcatgccttacacatgcaagtcgaacggtaacaggtcttcggatgctgacgagtggcgaacgggtgagtaatacatcggaacgtgcccgagagtgggggataacgaagcgaaagctttgctaataccgcatacgatctcaggatgaaagcaggggaccgcaaggccttgcgctcacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagactctggttaatacctggggtccatgacggtaccgtaagaataagcaccggctaactacgtgccagcagccgcggtaatacgtagggtgcgagcgttaatcggaattactgggcgtaaagcgtgcgcaggcggttatataagacagatgtgaaatccccgggctcaacctgggaactgcatttgtgactgtatagctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacagagggttgccaacccgcgagggggagccaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 1009 - DNA, 1537 bp, Acidovorax sp. 106
  ref <308>: DATABASE ACCESSION NUMBER: NCBI ACCESSION: NZ_RCCC01000001.1
  ref <309>: DATABASE ENTRY DATE: 2019-04-01
  ref <313>: RELEVANT RESIDUES IN SEQ ID NO: (1)..(1537)
agatcgaactgtagagtttgatcctggctcagattgaacgctggcggcatgccttacacatgcaagtcgaacggtaacaggtcttcggatgctgacgagtggcgaacgggtgagtaatacatcggaacgtgcccgatcgtgggggataacgaagcgaaagctttgctaataccgcataagatctaaggatgaaagcaggggaccgcaaggccttgcgcgaacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaaagactctggttaatacctggggtccatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtatggaatcctttagagatagaggagtgctcgaaagagagccataacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtagccgtatcggaaggtgcggctggatcacctcctttctg

SEQ ID NO: 1010 - DNA, 1537 bp, Acidovorax sp. 1608163; identical to SEQ ID NO: 1009
  ref <308>: DATABASE ACCESSION NUMBER: NCBI ACCESSION: NZ_CP033069.1
  ref <309>: DATABASE ENTRY DATE: 2019-04-01
  ref <313>: RELEVANT RESIDUES IN SEQ ID NO: (1)..(1537)

SEQ ID NO: 1011 - DNA, 1541 bp, Acidovorax sp. 93
  ref <308>: DATABASE ACCESSION NUMBER: NCBI ACCESSION: NZ_RBIT01000001.1
  ref <309>: DATABASE ENTRY DATE: 2019-04-01
  ref <313>: RELEVANT RESIDUES IN SEQ ID NO: (1)..(1541)
agatcgaactgtagagtttgatcctggctcagattgaacgctggcggcatgccttacacatgcaagtcgaacggtaacaggtcttcggatgctgacgagtggcgaacgggtgagtaatacatcggaacgtgcccgatcgtgggggataacggagcgaaagctttgctaataccgcatacgatctacggatgaaagcaggggaccgcaaggccttgcgcggacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaaagactccttctaataaagggggtccatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacagagggttgccaacccgcgagggggagccaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtagccgtatcggaaggtgcggctggatcacctcctttctg

SEQ ID NO: 1012 - DNA, 1541 bp, Acidovorax sp. 94; identical to SEQ ID NO: 1011
  ref <308>: DATABASE ACCESSION NUMBER: NCBI ACCESSION: NZ_RBJA01000001.1
  ref <309>: DATABASE ENTRY DATE: 2019-04-01
  ref <313>: RELEVANT RESIDUES IN SEQ ID NO: (1)..(1541)

SEQ ID NO: 1013 - DNA, 1541 bp, Acidovorax sp. 99; identical to SEQ ID NO: 1008
  ref <308>: DATABASE ACCESSION NUMBER: NCBI ACCESSION: NZ_QEKU01000001.1
  ref <309>: DATABASE ENTRY DATE: 2019-04-01
  ref <313>: RELEVANT RESIDUES IN SEQ ID NO: (1)..(1541)

SEQ ID NO: 1014 - DNA, 1537 bp, Acidovorax sp. CF301
  ref <308>: DATABASE ACCESSION NUMBER: NCBI ACCESSION: NZ_QAXU01000041.1
  ref <309>: DATABASE ENTRY DATE: 2019-04-01
  ref <313>: RELEVANT RESIDUES IN SEQ ID NO: (1)..(1537)
agatcgaactgtagagtttgatcctggctcagattgaacgctggcggcatgccttacacatgcaagtcgaacggtaacaggtcttcggatgctgacgagtggcgaacgggtgagtaatacatcggaacgtgcccgatcgtgggggataacggagcgaaagctttgctaataccgcatacgatctacggatgaaagcaggggaccgcaaggccttgcgcggacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaaagactccttctaataaagggggtccatgacggtaccgtaagaataagcaccggctaactacgtgccagcagccgcggtaatacgtagggtgcaagcgttaatcggaattactgggcgtaaagcgtgcgcaggcggttatgtaagacagatgtgaaatccccgggctcaacctgggaactgcatttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggatggtacaaagggtcgccaacccgcgagggggagccaatcccataaagccattcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 1015 - DNA, 1537 bp, Acidovorax sp. FJL06
  ref <308>: DATABASE ACCESSION NUMBER: NCBI ACCESSION: NZ_QAJR01000053.1
  ref <309>: DATABASE ENTRY DATE: 2019-04-01
  ref <313>: RELEVANT RESIDUES IN SEQ ID NO: (1)..(1537)
agatcgaactgtagagtttgatcctggctcagattgaacgctggcggcatgccttacacatgcaagtcgaacggtaacaggtcttcggatgctgacgagtggcgaacgggtgagtaatacatcggaacgtgcccgagagtgggggataacgaggcgaaagctttgctaataccgcatacgatctacggatgaaagcaggggaccgcaaggccttgcgctcacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagactccttctaataaagggggtccatgacggtaccgtaagaataagcaccggctaactacgtgccagcagccgcggtaatacgtagggtgcgagcgttaatcggaattactgggcgtaaagcgtgcgcaggcggttatataagacagatgtgaaatccccgggctcaacctgggaactgcatttgtgactgtatagctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtatggaatcctttagagatagaggagtgctcgaaagagagccataacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagccaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 1016 - DNA, 1537 bp, Acidovorax sp. GW101-3H11
  ref <308>: DATABASE ACCESSION NUMBER: NCBI ACCESSION: NZ_LUKZ01000020.1
  ref <309>: DATABASE ENTRY DATE: 2019-04-01
  ref <313>: RELEVANT RESIDUES IN SEQ ID NO: (1)..(1537)
agatcgaactgtagagtttgatcctggctcagattgaacgctggcggcatgccttacacatgcaagtcgaacggtaacaggtcttcggatgctgacgagtggcgaacgggtgagtaatacatcggaacgtgcccgagagtgggggataacgaggcgaaagctttgctaataccgcatacgatctcaggatgaaagcaggggaccgcaaggccttgcgctcacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagactccttctaataaagggggtccatgacggtaccgtaagaataagcaccggctaactacgtgccagcagccgcggtaatacgtagggtgcgagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtatggaatcctttagagatagaggagtgctcgaaagagagccataacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagccaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 1017 - DNA, 1540 bp, Acinetobacter baumannii
  ref <308>: DATABASE ACCESSION NUMBER: NCBI ACCESSION: NZ_ULHD01000072.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcgggggaaggtagcttgctactggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1018 - DNA, 1541 bp, Acinetobacter baylyi
  ref <308>: DATABASE ACCESSION NUMBER: NCBI ACCESSION: NZ_UICD01000001.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcgggggaaagtacttcggtactgaccttagcggcggacgggtgagtaatacttaggaatctgcctattagtgggggacaacatctcgaaagggatgctaataccgcatacgtcctacgggagaaagcaggggatctttatgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggcttacctggttaatacccaggataagtggacgttactcgcagaataagcaccggctaactctgtgccagcagccgcggtaatacagagggtgcaagcgttaatcggatttactgggcgtaaagcgcgcgtaggcggccaattaagtcaaatgtgaaatccccgagcttaacttgggaattgcattcgatactgattggctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagaaactttccagagatggattggtgccttcgggaatctacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1019 - DNA, 1542 bp, Acinetobacter bereziniae
  ref <308>: DATABASE ACCESSION NUMBER: NCBI ACCESSION: NZ_QWFV01000071.1
  ref <309>: DATABASE ENTRY DATE: 2019-04-01
  ref <313>: RELEVANT RESIDUES IN SEQ ID NO: (1)..(1542)
tttaactgaagagtttgatcatggctcagattgaacgctggcggcaggcttaacacatgcaagtcgagcgggggatgttgcttcggtaactgacctagcggcggacgggtgagtaatacttaggaatctgcctattaatgggggacaacatctcgaaagggatgctaataccgcatacgccctacgggggaaagcaggggatcacttgtgaccttgcgttaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctcttttggttaatacccaagatgagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggtctttgagactttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1020 - DNA, 1541 bp, Acinetobacter colistiniresistens
  ref <308>: DATABASE ACCESSION NUMBER: NCBI ACCESSION: NZ_BHGD02000039.1
  ref <309>: DATABASE ENTRY DATE: 2019-04-01
  ref <313>: RELEVANT RESIDUES IN SEQ ID NO: (1)..(1541)
ttaaactgaagagtttgatcatggctcagattgaacgctggcggcaggcttaacacatgcaagtcgagcggggaagggtagcttgctacctaacctagcggcggacgggtgagtaatgcttaggaatctgccatttagtgggggacaacattccgaaaggaatgctaataccgcatacgtcctacgggagaaagcaggggatcttcggaccttgcgctaaatgatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgaaagcctgatccagccatgccgcgtgtgtgaagaaggccttttggttgtaaagcactttaagcgaggaggaggctacctagattaatactctaggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1021 - DNA, 1542 bp, Acinetobacter guillouiae
  ref <308>: DATABASE ACCESSION NUMBER: NCBI ACCESSION: NZ_AP014630.1
  ref <309>: DATABASE ENTRY DATE: 2019-04-01
  ref <313>: RELEVANT RESIDUES IN SEQ ID NO: (1)..(1542)
tttaactgaagagtttgatcatggctcagattgaacgctggcggcaggcttaacacatgcaagtcgagcgggggagattgcttcggtaattgacctagcggcggacgggtgagtaatacttaggaatctgcctattaatgggggacaacatctcgaaagggatgctaataccgcatacgccctacgggggaaagcaggggatcacttgtgaccttgcgttaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctctcttggttaatacccaagatgagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1022 - DNA, 1583 bp, Acinetobacter halotolerans
  ref <308>: DATABASE ACCESSION NUMBER: NCBI ACCESSION: NZ_SGIM01000022.1
  ref <309>: DATABASE ENTRY DATE: 2019-04-01
  ref <313>: RELEVANT RESIDUES IN SEQ ID NO: (1)..(1583)
gatgagccaagattggtaccctttaaaggtactactgattttaaactgaagagtttgatcatggctcagattgaacgctggcggcaggcttaacacatgcaagtcgagcgggggaaagtagcttgctactggacctagcggcggacgggtgagtaatgcttaggaatctgcctattagtgggggacaacattccgaaagggatgctaataccgcatacgtcctacgggagaaagcaggggatcacttgtgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttggttaatacccagagatagtggacgttactcgcagaataagcaccggctaactctgtgccagcagccgcggtaatacagagggtgcgagcgttaatcggatttactgggcgtaaagcgtgcgtaggtggctaattaagtcaaatgtgaaatccccgagcttaacttgggaattgcattcgatactggttagctagagtatgggagaggatggtagaattccaggtgtagcggtgaaatgcgtagagatctggaggaataccgatggcgaaggcagccatctggcctaatactgacactgaggtacgaaagcatggggagcaaacaggattagataccctggtagtccatgccgtaaacgatgtctactagccgttggggtctttgagactttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagaaactttccagagatggattggtgccttcgggaatctacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1023 - DNA, 788 bp, Acinetobacter indicus
  ref <308>: DATABASE ACCESSION NUMBER: NCBI ACCESSION: NZ_RZUA01000144.1
  ref <309>: DATABASE ENTRY DATE: 2019-04-01
  ref <313>: RELEVANT RESIDUES IN SEQ ID NO: (1)..(788)
gaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggcgctctaggctaataccctagatgcgtggacgttactcgcagaataagcaccggctaactctgtgccagcagccgcggtaatacagagggtgcgagcgttaatcggatttactgggcgtaaagcgcgcgtaggtggctaattaagtcaaatgtgaaatccccgagcttaacttgggaattgcattcgatactggttagctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacata

SEQ ID NO: 1024 - DNA, 1541 bp, Acinetobacter johnsonii
  ref <308>: DATABASE ACCESSION NUMBER: NCBI ACCESSION: NZ_UFRV01000006.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcggggaaaggtagcttgctacctaacctagcggcggacgggtgagtaatgcttaggaatctgcctattagtgggggacaacattccgaaaggaatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatgggcgaaagcctgatccagccatgccgcgtgtgtgaagaaggccttttggttgtaaagcactttaagcgaggaggaggctacttggattaatactctaggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtagccgtaggggaacctgcggctggatcacctccttaa

SEQ ID NO: 1025 - DNA, 1540 bp, Acinetobacter junii
  ref <308>: DATABASE ACCESSION NUMBER: NCBI ACCESSION: NZ_UFRZ01000001.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcggagatgaggtgcttgcaccttatcttagcggcggacgggtgagtaatgcttaggaatctgcctattagtgggggacaacattccgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactgagactaatactcttggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggctggatcacctccttaa

SEQ ID NO: 1026 - DNA, 1541 bp, Acinetobacter lactucae
  ref <308>: DATABASE ACCESSION NUMBER: NCBI ACCESSION: NZ_RFES01000022.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcggggtgatggtgcttgcactatcacctagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactttagataatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1027 - DNA, 1581 bp, Acinetobacter lwoffii
  ref <308>: DATABASE ACCESSION NUMBER: NCBI ACCESSION: NZ_UFSE01000003.1
  ref <309>: DATABASE ENTRY DATE: 2019-04-01
  ref <313>: RELEVANT RESIDUES IN SEQ ID NO: (1)..(1581)
gatgagccaagattggtgccctttaaggcactacatagtattaaactgaagagtttgatcatggctcagattgaacgctggcggcaggcttaacacatgcaagtcgagcggggaaatgtagcttgctacattacctagcggcggacgggtgagtaatgcttaggaatctgcctattagtgggggacaacatctcgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctaccgagattaatactcttggatagtggacgttactcgcagaataagcaccggctaactctgtgccagcagccgcggtaatacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttaggggggacgcttaccacggtgtggcagatgactggggtgaagtcgtaacaaggtagccgtaggggaacctgcggctggatcacctccttaa

SEQ ID NO: 1028 - DNA, 1541 bp, Acinetobacter nosocomialis
  ref <308>: DATABASE ACCESSION NUMBER: NCBI ACCESSION: NZ_RFEG01000103.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactttagataatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttatatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1029 - DNA, 1541 bp, Acinetobacter oleivorans
  ref <308>: DATABASE ACCESSION NUMBER: NCBI ACCESSION: NZ_UEFW01000011.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcggagagaggtagcttgctactgatcttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1030 - DNA, 1168 bp, Acinetobacter piscicola
  ref <308>: DATABASE ACCESSION NUMBER: NCBI ACCESSION: NZ_SEUF01000001.1
  ref <309>: DATABASE ENTRY DATE: 2019-04-01
  ref <313>: RELEVANT RESIDUES IN SEQ ID NO: (1)..(1168)
ttaaactgaagagtttgatcatggctcagattgaacgctggcggcaggcttaacacatgcaagtcgagcgggggaaggtagcttgctactggacctagcggcggacgggtgagtaatacttaggaatctgcctattagtgggggacaacatctcgaaagggatgctaataccgcatacgccctacgggggaaagcaggggatcatttgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattgcacaatgggggaaaccctgatccagccatgccgcgtgtgtgaagaaggccttcgggttgtaaagcactttaagcggggaggaggctactttggttaatacctaaagatagtggacgttactcgcagaataagcatcggctaactctgtgccagcagccgcggtaatacagaggatgcaagcgttaatcggaattactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccggtggcgaaggcggccctctggcctaatactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaatgcgaaaaatcttacctggtcttgacatagtaagaacattccagagatggattggtgccttcgggaacttacatacaggtgctacatgggtgtcgtcagctcgtgtcgtgagacgttgggttaagtctcgcaacgagcgcaacccttttgcttattcgctaggactaagggtggtaacttgaaggctcccggcagagccaaa

SEQ ID NO: 1031 - DNA, 1547 bp, Acinetobacter puyangensis
  ref <308>: DATABASE ACCESSION NUMBER: NCBI ACCESSION: NZ_OANT01000023.1
  ref <309>: DATABASE ENTRY DATE: 2019-04-01
  ref <313>: RELEVANT RESIDUES IN SEQ ID NO: (1)..(1547)
tttaactgaagagtttgatcatggctcagattgaacgctggcggcaggcttaacacatgcaagtcgagcggttttatgtagcttgctacataagatagcggcggacgggtgagtaatacttaggaatctgcctattagtgggggacaacgtttcgaaagggacgctaataccgcatacgtcctacgggagaaagcaggggatcacttgtgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggcatttttgttgtaaagcactttaagcgaggaggaggctctcttagataatacctaaggtgagtggacgttactcgcagaataagcaccggctaactctgtgccagcagccgcggtaatacagagggtgcgagcgttaatcggatttactgggcgtaaagcgtgcgtaggcggctaattaagtcaaatgtgaaatccccgagcttaacttgggaattgcattcgatactggttagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagaaactttccagagatggattggtgccttcgggaatctacatacaggtgctgcatggctgtcgtcagctcgtgtcgtgagatgttgggttaagtcccgcaacgagcgcaacccttttccttacttgccatcgggtaatgccgggaactttaaggatactgccagtgacaaactggaggaaggcggggacgacgtcaagtcatcatggcccttacggccagggctacacacgtgctacaatggtcggtacaaagggttgctacatagcgatatgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaacgaa

SEQ ID NO: 1032 - DNA, 1287 bp, Acinetobacter radioresistens
  ref <308>: DATABASE ACCESSION NUMBER: NCBI ACCESSION: NZ_RFEZ01000076.1
  ref <309>: DATABASE ENTRY DATE: 2019-04-01
  ref <313>: RELEVANT RESIDUES IN SEQ ID NO: (1)..(1287)
gggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctacctagattaatactttaggatagtggacgttactcgcagaataagcaccggctaactctgtgccagcagccgcggtaatacagagggtgcgagcgttaatcggatttactgggcgtaaagcgtgcgtaggcggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcccttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatacagagaactttccagagatggattggtgccttcgggaactctgatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggctggatcacctccttaa

SEQ ID NO: 1033 - DNA, 1541 bp, Acinetobacter schindleri
  ref <308>: DATABASE ACCESSION NUMBER: NCBI ACCESSION: NZ_CP025618.2
  ref <309>: DATABASE ENTRY DATE: 2019-04-01
  ref <313>: RELEVANT RESIDUES IN SEQ ID NO: (1)..(1541)
ttaaactgaagagtttgatcatggctcagattgaacgctggcggcaggcttaacacatgcaagtcgagcggggaaggttgcttcggtaactgacctagcggcggacgggtgagtaatgcttaggaatctgcctattagtgggggacaacgttccgaaaggaacgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctcctttagttaatacctaaagtgagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactggaaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccatcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1034 - DNA, 1541 bp, Acinetobacter seifertii
  ref <308>: DATABASE ACCESSION NUMBER: NCBI ACCESSION: NZ_QAYP01000149.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcggagagaggtagcttgctactgatcttagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1035 - DNA, 1540 bp, Acinetobacter sp. 1000160
  ref <308>: DATABASE ACCESSION NUMBER: NCBI ACCESSION: NZ_JFWP02000004.1
  ref <309>: DATABASE ENTRY DATE: 2019-04-01
  ref <313>: RELEVANT RESIDUES IN SEQ ID NO: (1)..(1540)
ttaaactgaagagtttgatcatggctcagattgaacgctggcggcaggcttaacacatgcaagtcgagcggggaaggttgcttcggtaactgacccagcggcggacgggtgagtaatgcttaggaatctgccatttagtgggggacaacattccgaaaggaatgctaataccgcatacgtcctacgggagaaagcaggggatcttcggaccttgcgctaaatgatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttttggttgtaaagcactttaagcgaggaggaggctctcttagttaatacctaagatgagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1036 - DNA, 1541 bp, Acinetobacter sp. 1564232
  ref <308>: DATABASE ACCESSION NUMBER: NCBI ACCESSION: NZ_JFEL02000001.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcggagagaggtagcttgctactgatcttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccatcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1037 - DNA, 1581 bp, Acinetobacter sp. 2JN-4
  ref <308>: DATABASE ACCESSION NUMBER: NCBI ACCESSION: NZ_RDNY01000018.1
  ref <309>: DATABASE ENTRY DATE: 2019-04-01
  ref <313>: RELEVANT RESIDUES IN SEQ ID NO: (1)..(1581)
gatgagccaagattggtaccctttaaaggtactactgattttaaactgaagagtttgatcatggctcagattgaacgctggcggcaggcttaacacatgcaagtcgagcggggaagagtagcttgctactttacctagcggcggacgggtgagtaatgcttaggaatctgcctattagtgggggacaacattccgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctacctagattaatactctaggatagtggacgttactcgcagaataagcaccggctaactctgtgccagcagccgcggtaatacagagggtgcgagcgttaatcggatttactgggcgtaaagcgtgcgtaggtggctaattaagtcaaatgtgaaatccccgagcttaacttgggaattgcattcgatactggttagctagagtatgggagaggatggtagaattccaggtgtagcggtgaaatgcgtagagatctggaggaataccgatggcgaaggcagccatctggcctaatactgacactgaggtacgaaagcatggggagcaaacaggattagataccctggtagtccatgccgtaaacgatgtctactagccgttggggtctttgagactttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagaaactttccagagatggattggtgccttcgggaatctacatacaggtgctgcatggctgtcgtcagctcgtgtcgtgagatgttgggttaagtcccgcaacgagcgcaacccttttccttatttgccagcgggtaatgccgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1038 - DNA, 924 bp, Acinetobacter sp. 51m
  ref <308>: DATABASE ACCESSION NUMBER: NCBI ACCESSION: NZ_LZDF01000067.1
  ref <309>: DATABASE ENTRY DATE: 2019-04-01
  ref <313>: RELEVANT RESIDUES IN SEQ ID NO: (1)..(924)
acctagcggcggacgggtgagtaatgcttaggaatctgcctattagtgggggacaacatctcgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctaccgagattaatactcttggatagtggacgttactcgcagaataagcaccggctaactctgtgccagcagccgcggtaatacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatgg

SEQ ID NO: 1039 - DNA, 1540 bp, Acinetobacter sp. AKBS16
  ref <308>: DATABASE ACCESSION NUMBER: NCBI ACCESSION: NZ_POYH01000001.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1040 - DNA, 1540 bp, Acinetobacter sp. AM
  ref <308>: DATABASE ACCESSION NUMBER: NCBI ACCESSION: NZ_QETG01000049.1
  ref <309>: DATABASE ENTRY DATE: 2019-04-01
  ref <313>: RELEVANT RESIDUES IN SEQ ID NO: (1)..(1540)
ttaaactgaagagtttgatcatggctcagattgaacgctggcggcaggcttaacacatgcaagtcgagcggagtggttgtgcttgcacaatcacttagcggcggacgggtgagtaatgcttaggaatctgcctattagtgggggacaacattccgaaaggaatgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctactagtactaatactactggatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1041 - DNA, 1540 bp, Acinetobacter sp. B51 2017
  ref <308>: DATABASE ACCESSION NUMBER: NCBI ACCESSION: NZ_PJRJ01000076.1
  ref <309>: DATABASE ENTRY DATE: 2019-04-01
  ref <313>: RELEVANT RESIDUES IN SEQ ID NO: (1)..(1540)
ttaaactgaagagtttgatcatggctcagattgaacgctggcggcaggcttaacacatgcaagtcgagcggatgaaggtagcttgctactggattcagcggcggacgggtgagtaatgcttaggaatctgcccattaatgggggacaacagttggaaacgactgctaataccgcatacgccctacgggggaaagcaggggatcttcggaccttgcgttaatggatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgaaagcctgatccagccatgccgcgtgtgtgaagaaggccttttggttgtaaagcactttaagtggggaggaggctaccaagattaatactcttggatagtggacgttacccacagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatacagagaactttccagagatggattggtgccttcgggaactctgatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1042 - DNA, 1086 bp, Acinetobacter sp. BIGb0102
  ref <308>: DATABASE ACCESSION NUMBER: NCBI ACCESSION: NZ_RKQE01000007.1
  ref <309>: DATABASE ENTRY DATE: 2019-04-01
  ref <313>: RELEVANT RESIDUES IN SEQ ID NO: (1)..(1086)
agtattaatactactggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1043 - DNA, 1541 bp, Acinetobacter sp. FDAARGOS 131
  ref <308>: DATABASE ACCESSION NUMBER: NCBI ACCESSION: NZ_LORV02000002.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcgggggaaggtagcttgctactggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactttagataatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1044 - DNA, 1540 bp, Acinetobacter sp. FDAARGOS 493; identical to SEQ ID NO: 1039
  ref <308>: DATABASE ACCESSION NUMBER: NCBI ACCESSION: NZ_CP033858.1
  ref <309>: DATABASE ENTRY DATE: 2019-04-01
  ref <313>: RELEVANT RESIDUES IN SEQ ID NO: (1)..(1540)

SEQ ID NO: 1045 - DNA, 1540 bp, Acinetobacter sp. FDAARGOS 494
  ref <308>: DATABASE ACCESSION NUMBER: NCBI ACCESSION: NZ_CP033866.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcgggggaaggtagcttgctactggacctagcggcggacgggtgagtaatgcttaggaatctgcctattagtgggggataacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1046 - DNA, 1540 bp, Acinetobacter sp. FDAARGOS 495
  ref <308>: DATABASE ACCESSION NUMBER: NCBI ACCESSION: NZ_RKJL01000003.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgcctcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1047 - DNA, 1542 bp, Acinetobacter sp. FDAARGOS 515
  ref <308>: DATABASE ACCESSION NUMBER: NCBI ACCESSION: NZ_RKIX01000003.1
  ref <309>: DATABASE ENTRY DATE: 2019-04-01
  ref <313>: RELEVANT RESIDUES IN SEQ ID NO: (1)..(1542)
tttaactgaagagtttgatcatggctcagattgaacgctggcggcaggcttaacacatgcaagtcgagcggagagaagtagcttgctactgatcttagcggcggacgggtgagtaatacttaggaatctggctattagtgggggacaacatttcgaaagggatgctaataccgcatacgtcctacgggagaaagcaggggatcagtaatgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggagggtactggtattaatactaccagctactggacgttactcgcagaataagcaccggctaactctgtgccagcagccgcggtaatacagagggtgcgagcgttaatcggatttactgggcgtaaagcgtgcgtaggcggctaattgagtcggatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtacgaaagcatggggagcaaacaggattagataccctggtagtccatgccgtaaacgatgtctactagccgttggtctctttgagggattagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcactttgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtggatagtctaactgcaaagaggacgttcaccacggtgtggccgatgactggggtgaagtcgtaacaaggtagccgtaggggaacctgcggctggatcacctccttaa

SEQ ID NO: 1048 - DNA, 1541 bp, Acinetobacter sp. FDAARGOS 541; identical to SEQ ID NO: 1043
  ref <308>: DATABASE ACCESSION NUMBER: NCBI ACCESSION: NZ_RKIR01000004.1
  ref <309>: DATABASE ENTRY DATE: 2019-04-01
  ref <313>: RELEVANT RESIDUES IN SEQ ID NO: (1)..(1541)

SEQ ID NO: 1049 - DNA, 1540 bp, Acinetobacter sp. FDAARGOS 558; identical to SEQ ID NO: 1017
  ref <308>: DATABASE ACCESSION NUMBER: NCBI ACCESSION: NZ_RKJH01000001.1
  ref <309>: DATABASE ENTRY DATE: 2019-04-01
  ref <313>: RELEVANT RESIDUES IN SEQ ID NO: (1)..(1540)

SEQ ID NO: 1050 - DNA, 1540 bp, Acinetobacter sp. FDAARGOS 559; identical to SEQ ID NO: 1039
  ref <308>: DATABASE ACCESSION NUMBER: NCBI ACCESSION: NZ_RKJG01000005.1
  ref <309>: DATABASE ENTRY DATE: 2019-04-01
  ref <313>: RELEVANT RESIDUES IN SEQ ID NO: (1)..(1540)

SEQ ID NO: 1051 - DNA, 1540 bp, Acinetobacter sp. FDAARGOS 560; identical to SEQ ID NO: 1017
  ref <308>: DATABASE ACCESSION NUMBER: NCBI ACCESSION: NZ_CP033862.1
  ref <309>: DATABASE ENTRY DATE: 2019-04-01
  ref <313>: RELEVANT RESIDUES IN SEQ ID NO: (1)..(1540)

SEQ ID NO: 1052 - DNA, 1541 bp, Acinetobacter sp. JW
  ref <308>: DATABASE ACCESSION NUMBER: NCBI ACCESSION: NZ_QUZJ01000026.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcggggtgatggtgcttgcactatcacttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1053 - DNA, 1540 bp, Acinetobacter sp. KPC-SM-21
  ref <308>: DATABASE ACCESSION NUMBER: NCBI ACCESSION: NZ_OOGT01000238.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcgggcgaggttgcttcggtaactgagctagcggcggacgggtgagtaatacttaggaatctgcctattagtgggggacaacgtttcgaaagggacgctaataccgcatacgccctacgggggaaagcaggggatcgtaagaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggagagtactctggttaatacccagaattactggacgttactcgcagaataagcaccggctaactctgtgccagcagccgcggtaatacagagggtgcgagcgttaatcggatttactgggcgtaaagcgtgcgtaggcggctaattaagtcggatgtgaaatccccgagctcaacttgggaattgcattcgatactggttagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttctagagatagattggtgccttcgggaacttagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacatagcgatatgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaacttaattgagggcggttaccacggtgtggccgatgactggggtgaagtcgtaacaaggtagccgtaggggaacctgcggctggatcacctccttaa

SEQ ID NO: 1054 - DNA, 1540 bp, Acinetobacter sp. NCTC 10304
  ref <308>: DATABASE ACCESSION NUMBER: NCBI ACCESSION: NZ_AIEE01000175.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcgggggaaggtagcttgctactggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactctagttaatacctagggatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1055 - DNA, 1541 bp, Acinetobacter sp. NCTC 7422
  ref <308>: DATABASE ACCESSION NUMBER: NCBI ACCESSION: NZ_AIED01000108.1
  ref <309>: DATABASE ENTRY DATE: 2019-04-01
  ref <313>: RELEVANT RESIDUES IN SEQ ID NO: (1)..(1541)
ttaaactgaagagtttgatcatggctcagattgaacgctggcggcaggcttaacacatgcaagtcgagcggggaagggtagcttgctacctaacctagcggcggacgggtgagtaatgcttaggaatctgccatttagtgggggacaacattccgaaaggaatgctaataccgcatacgtcctacgggagaaagcaggggatcttcggaccttgcgctaaatgatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttatggttgtaaagcactttaagcgaggaggaggctacttagattaatactctaggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggctggatcacctccttaa

SEQ ID NO: 1056 - DNA, 1540 bp, Acinetobacter sp. S131434; identical to SEQ ID NO: 1017
  ref <308>: DATABASE ACCESSION NUMBER: NCBI ACCESSION: NZ_QVQG01000038.1
  ref <309>: DATABASE ENTRY DATE: 2019-04-01
  ref <313>: RELEVANT RESIDUES IN SEQ ID NO: (1)..(1540)

SEQ ID NO: 1057 - DNA, 1581 bp, Acinetobacter sp. SWAC5
  ref <308>: DATABASE ACCESSION NUMBER: NCBI ACCESSION: NZ_QUWR01000051.1
  ref <309>: DATABASE ENTRY DATE: 2019-04-01
  ref <313>: RELEVANT RESIDUES IN SEQ ID NO: (1)..(1581)
gatgagccaagattggtaccctttaaaggtactattgattttaaactgaagagtttgatcatggctcagattgaacgctggcggcaggcttaacacatgcaagtcgagcgggaataggtagcttgctaccgatttctagcggcggacgggtgagtaatgcttaggaatctgcctattagtgggggacaacatttcgaaagggatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctactctagttaatacctagggatagtggacgttactcgcagaataagcaccggctaactctgtgccagcagccgcggtaatacagagggtgcgagcgttaatcggatttactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcggttcggccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgacgactggggtgaagtcgtaacaaggtagccgtaggggaacctgcggctggatcacctccttaa

SEQ ID NO: 1058 - DNA, 1540 bp, Acinetobacter sp. SWAC57
  ref <308>: DATABASE ACCESSION NUMBER: NCBI ACCESSION: NZ_KZ984429.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcggggggaggtagcttgctacctaacctagcggcggacgggtgagtaatgcttaggaatctgcctattagtgggggacaacatttcgaaagggatgctaataccgcatacgccctaagggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctaccgagattaatactcttggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggctggatcacctccttaa

SEQ ID NO: 1059 - DNA, 282 bp, Acinetobacter sp. V2
  ref <308>: DATABASE ACCESSION NUMBER: NCBI ACCESSION: NZ_JZFB01000008.1
  ref <309>: DATABASE ENTRY DATE: 2019-04-01
  ref <313>: RELEVANT RESIDUES IN SEQ ID NO: (1)..(282)
cctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggagaagtcgtaacaaggtagccgtaggggaacctgcggctggatcacctccttaa

SEQ ID NO: 1060 - DNA, 1541 bp, Acinetobacter sp. WCHA55
  ref <308>: DATABASE ACCESSION NUMBER: NCBI ACCESSION: NZ_CP032286.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcgggggatgttgcttcggtaactgacctagcggcggacgggtgagtaatgcttaggaatctgcctattagtgggggacaacattccgaaaggaatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctactgagactaatactcttggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccatcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtagccgtaggggaacctgcggctggatcacctccttaa

SEQ ID NO: 1061 - DNA, 1580 bp, Acinetobacter sp. WCHAc010005
  ref <308>: DATABASE ACCESSION NUMBER: NCBI ACCESSION: NZ_CP032134.1
  ref <309>: DATABASE ENTRY DATE: 2019-04-01
  ref <313>: RELEVANT RESIDUES IN SEQ ID NO: (1)..(1580)
gatgagccaagattggcaccctttaaggtgctagcaagtattaaactgaagagtttgatcatggctcagattgaacgctggcggcaggcttaacacatgcaagtcgagcggagagaggtagcttgctactgatcttagcggcggacgggtgagtaatgcttaggaatctgcctattagtgggggacaacattccgaaaggaatgctaataccgcatacgccctacgggggaaagcaggggatcattagaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctactctggttaatacctggagatagtggacgttactcgcagaataagcaccggctaactctgtgccagcagccgcggtaatacagagggtgcgagcgttaatcggatttactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgacgactggggtgaagtcgtaacaaggtagccgtaggggaacctgcggctggatcacctccttaa

SEQ ID NO: 1062 - DNA, 1541 bp, Acinetobacter sp. WCHAc010034
  ref <308>: DATABASE ACCESSION NUMBER: NCBI ACCESSION: NZ_CP032279.1
  ref <309>: DATABASE ENTRY DATE: 2019-04-01
  ref <313>: RELEVANT RESIDUES IN SEQ ID NO: (1)..(1541)
ttaaactgaagagtttgatcatggctcagattgaacgctggcggcaggcttaacacatgcaagtcgagcggggagatgtagcttgctacatttcctagcggcggacgggtgagtaatgcttaggaatctgcctattagtgggggacaacgtttcgaaaggaacgctaataccgcatacgccctacgggggaaagcaggggatcttcggaccttgcgctaatagatgagcctaagccagattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcggggaggaggctcttctagttaatacctaggatgagtggacgttacccgcagaataagcaccggctaactctgtgccagcagccgcggtaatacagagggtgcgagcgttaatcggatttactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgacgactggggtgaagtcgtaacaaggtagccgtaggggaacctgcggctggatcacctccttaa

SEQ ID NO: 1063 - DNA, 1582 bp, Acinetobacter sp. WCHAc010052
  ref <308>: DATABASE ACCESSION NUMBER: NCBI ACCESSION: NZ_CP032143.1
  ref <309>: DATABASE ENTRY DATE: 2019-04-01
  ref <313>: RELEVANT RESIDUES IN SEQ ID NO: (1)..(1582)
gatgagccaagattggtgccctttaaggcactagcaagtattaaactgaagagtttgatcatggctcagattgaacgctggcggcaggcttaacacatgcaagtcgagcggagagaggtagcttgctactgatcttagcggcggacgggtgagtaatgcttaggaatctgcctattagtgggggacaacattccgaaagggatgctaataccgcatacgccctacgggggaaagcaggggatcacttgtgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctactctggttaatacccagggatagtggacgttactcgcagaataagcaccggctaactctgtgccagcagccgcggtaatacagagggtgcgagcgttaatcggatttactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgacgactggggtgaagtcgtaacaaggtagccgtaggggaacctgcggctggatcacctccttaa

SEQ ID NO: 1064 - DNA, 1581 bp, Acinetobacter sp. WCHAc060001; identical to SEQ ID NO: 1057
  ref <308>: DATABASE ACCESSION NUMBER: NCBI ACCESSION: NZ_RCHE01000091.1
  ref <309>: DATABASE ENTRY DATE: 2019-04-01
  ref <313>: RELEVANT RESIDUES IN SEQ ID NO: (1)..(1581)

SEQ ID NO: 1065 - DNA, 1581 bp, Acinetobacter sp. WCHAc060002; identical to SEQ ID NO: 1057
  ref <308>: DATABASE ACCESSION NUMBER: NCBI ACCESSION: NZ_RAXZ01000055.1
  ref <309>: DATABASE ENTRY DATE: 2019-04-01
  ref <313>: RELEVANT RESIDUES IN SEQ ID NO: (1)..(1581)

SEQ ID NO: 1066 - DNA, 1581 bp, Acinetobacter sp. WCHAc060003; identical to SEQ ID NO: 1057
  ref <308>: DATABASE ACCESSION NUMBER: NCBI ACCESSION: NZ_RCHD01000091.1
  ref <309>: DATABASE ENTRY DATE: 2019-04-01
  ref <313>: RELEVANT RESIDUES IN SEQ ID NO: (1)..(1581)

SEQ ID NO: 1067 - DNA, 1581 bp, Acinetobacter sp. WCHAc060004; identical to SEQ ID NO: 1057
  ref <308>: DATABASE ACCESSION NUMBER: NCBI ACCESSION: NZ_RAXY01000070.1
  ref <309>: DATABASE ENTRY DATE: 2019-04-01
  ref <313>: RELEVANT RESIDUES IN SEQ ID NO: (1)..(1581)

SEQ ID NO: 1068 - DNA, 1579 bp, Acinetobacter sp. WCHAc060005
  ref <308>: DATABASE ACCESSION NUMBER: NCBI ACCESSION: NZ_RCHC01000044.1
  ref <309>: DATABASE ENTRY DATE: 2019-04-01
  ref <313>: RELEVANT RESIDUES IN SEQ ID NO: (1)..(1579)
gatgagccaagattggtaccctttaaggtactattgattttaaactgaagagtttgatcatggctcagattgaacgctggcggcaggcttaacacatgcaagtcgagcggatgaagggagcttgctcctggattcagcggcggacgggtgagtaatgcttaggaatctgcctattagtgggggacaacatttcgaaagggatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctcttctagttaatacctaggatgagtggacgttactcgcagaataagcaccggctaactctgtgccagcagccgcggtaatacagagggtgcgagcgttaatcggatttactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcggttcggccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgacgactggggtgaagtcgtaacaaggtagccgtaggggaacctgcggctggatcacctccttaa

SEQ ID NO: 1069 - DNA, 1541 bp, Acinetobacter sp. WCHAc060006
  ref <308>: DATABASE ACCESSION NUMBER: NCBI ACCESSION: NZ_SGSS01000074.1
  ref <309>: DATABASE ENTRY DATE: 2019-04-01
  ref <313>: RELEVANT RESIDUES IN SEQ ID NO: (1)..(1541)
ttaaactgaagagtttgatcatggctcagattgaacgctggcggcaggcttaacacatgcaagtcgagcgggaataggtagcttgctaccgatttctagcggcggacgggtgagtaatgcttaggaatctgcctattagtgggggacaacatttcgaaagggatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctactctagttaatacctagggatagtggacgttactcgcagaataagcaccggctaactctgtgccagcagccgcggtaatacagagggtgcgagcgttaatcggatttactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcggttcggccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgacgactggggtgaagtcgtaacaaggtagccgtaggggaacctgcggctggatcacctccttaa

SEQ ID NO: 1070 - DNA, 1579 bp, Acinetobacter sp. WCHAc060007; identical to SEQ ID NO: 1068
  ref <308>: DATABASE ACCESSION NUMBER: NCBI ACCESSION: NZ_RAXX01000045.1
  ref <309>: DATABASE ENTRY DATE: 2019-04-01
  ref <313>: RELEVANT RESIDUES IN SEQ ID NO: (1)..(1579)

SEQ ID NO: 1071 - DNA, 1541 bp, Acinetobacter sp. WCHAc060008; identical to SEQ ID NO: 1069
  ref <308>: DATABASE ACCESSION NUMBER: NCBI ACCESSION: NZ_RAXW01000080.1
  ref <309>: DATABASE ENTRY DATE: 2019-04-01
  ref <313>: RELEVANT RESIDUES IN SEQ ID NO: (1)..(1541)

SEQ ID NO: 1072 - DNA, 1579 bp, Acinetobacter sp. WCHAc060012
  ref <308>: DATABASE ACCESSION NUMBER: NCBI ACCESSION: NZ_RAXV01000064.1
  ref <309>: DATABASE ENTRY DATE: 2019-04-01
  ref <313>: RELEVANT RESIDUES IN SEQ ID NO: (1)..(1579)
gatgagccaagattggcaccctttaaggtgctattgattttaaactgaagagtttgatcatggctcagattgaacgctggcggcaggcttaacacatgcaagtcgagcggatgaaagtagcttgctactggattcagcggcggacgggtgagtaatgcttaggaatctgcctattagtgggggacaacattccgaaagggatgctaataccgcatacgccctacgggggaaagcaggggatcttcggaccttgcgctaatagatgagcctaagtcagattagctagttggtagggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggagctctagattaatactctagatgcttggacgttactcgcagaataagcaccggctaactctgtgccagcagccgcggtaatacagagggtgcgagcgttaatcggatttactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccctttccttatttgccagcggttcggccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1073 - DNA, 1542 bp, Acinetobacter sp. WCHAc060025
  ref <308>: DATABASE ACCESSION NUMBER: NCBI ACCESSION: NZ_SGSX01000045.1
  ref <309>: DATABASE ENTRY DATE: 2019-04-01
  ref <313>: RELEVANT RESIDUES IN SEQ ID NO: (1)..(1542)
tttaactgaagagtttgatcatggctcagattgaacgctggcggcaggcttaacacatgcaagtcgagcgggggaagttgcttcggtaactgacctagcggcggacgggtgagtaatacttaggaatctgcctattagtgggggacaacgtttcgaaaggaacgctaataccgcatacgtcctacgggagaaagcaggggatcacttgtgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggggctcttggttaatacccaagatgcttggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtagaaactttccagagatggattggtgccttcgggaatctacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1074 - DNA, 1542 bp, Acinetobacter sp. WCHAc060033
  ref <308>: DATABASE ACCESSION NUMBER: NCBI ACCESSION: NZ_SGSW01000130.1
  ref <309>: DATABASE ENTRY DATE: 2019-04-01
  ref <313>: RELEVANT RESIDUES IN SEQ ID NO: (1)..(1542)
tttaactgaagagtttgatcatggctcagattgaacgctggcggcaggcttaacacatgcaagtcgagcggggggagttgcttcggtaactgacctagcggcggacgggtgagtaatacttaggaatctgcctattagtgggggacaacgtttcgaaaggaacgctaataccgcatacgtcctacgggagaaagcaggggatcacttgtgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggagctcttggttaatacccaagatgcttggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtagaaactttccagagatggattggtgccttcgggaatctacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1075 - DNA, 1540 bp, Acinetobacter sp. WCHAc060041
  ref <308>: DATABASE ACCESSION NUMBER: NCBI ACCESSION: NZ_PYIX02000082.1
  ref <309>: DATABASE ENTRY DATE: 2019-04-01
  ref <313>: RELEVANT RESIDUES IN SEQ ID NO: (1)..(1540)
ttaaactgaagagtttgatcatggctcagattgaacgctggcggcaggcttaacacatgcaagtcgagcggatgaaagtagcttgctactggatttagcggcggacgggtgagtaatacttaggaatctgcctattagtgggggacaacatctcgaaagggatgctaataccgcatacgccctacgggggaaagcaggggatcgtaagaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttggttaatacccagagatagtggacgttactcgcagaataagcaccggctaactctgtgccagcagccgcggtaatacagagggtgcgagcgttaatcggatttactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgacgactggggtgaagtcgtaacaaggtagccgtaggggaacctgcggctggatcacctccttaa

SEQ ID NO: 1076 - DNA, 1540 bp, Acinetobacter sp. WCHAc060096
  ref <308>: DATABASE ACCESSION NUMBER: NCBI ACCESSION: NZ_RAXU01000056.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcgggggaaggtgcttcggtactgaccttagcggcggacgggtgagtaatgcttaggaatctggctattagtgggggacaacgtttcgaaagggacgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggagggtactggtattaatactaccagctactggacgttactcgcagaataagcaccggctaactctgtgccagcagccgcggtaatacagagggtgcgagcgttaatcggatttactgggcgtaaagcgtgcgtaggcggctaattgagtcggatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtacgaaagcatggggagcaaacaggattagataccctggtagtccatgccgtaaacgatgtctactagccgttggtctctttgagggattagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggagcttacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctccttaa

SEQ ID NO: 1077 - DNA, 1540 bp, Acinetobacter sp. WCHAc060115
  ref <308>: DATABASE ACCESSION NUMBER: NCBI ACCESSION: NZ_RAXT01000097.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcgggggaggttgcttcggtaactgacctagcggcggacgggtgagtaatgcttaggaatctgccatttagtgggggacaacattccgaaaggaatgctaataccgcatacgtcctacgggagaaagcaggggatcttcggaccttgcgctaaatgatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctcctgtagttaatacctatagagagtggacgttactcgcagaataagcaccggctaactctgtgccagcagccgcggtaatacagagggtgcgagcgttaatcggatttactgggcgtaaagcgtacgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttagggaggacgcttaccacggtgtggccgacgactggggtgaagtcgtaacaaggtagccgtaggggaacctgcggctggatcacctccttaa

SEQ ID NO: 1078 - DNA, 1540 bp, Acinetobacter ursingii
  ref <308>: DATABASE ACCESSION NUMBER: NCBI ACCESSION: NZ_AP018824.1
  ref <309>: DATABASE ENTRY DATE: 2019-04-01
  ref <313>: RELEVANT RESIDUES IN SEQ ID NO: (1)..(1540)
tttaactgaagagtttgatcatggctcagattgaacgctggcggcaggcttaacacatgcaagtcgagcggagagaggtagcttgctactgatcttagcggcggacgggtgagtaatacttaggaatctggctattagtgggggacaacatttcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggagggtactggtattaatactaccaggtactggacgttactcgcagaataagcaccggctaactctgtgccagcagccgcggtaatacagagggtgcgagcgttaatcggatttactgggcgtaaagcgtgcgtaggcggctaattgagtcggatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtacgaaagcatggggagcaaacaggattagataccctggtagtccatgccgtaaacgatgtctactagccgttggtctctttgagggattagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcactttgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtggatagtctaactgcaaagaggacgttcaccacggtgtggccgatgactggggtgaagtcgtaacaaggtagccgtaggggaacctgcggctggatcacctccttaa

SEQ ID NO: 1079 - DNA, 1541 bp, Acinetobacter variabilis
  ref <308>: DATABASE ACCESSION NUMBER: NCBI ACCESSION: NZ_RHWY01000133.1
  ref <309>: DATABASE ENTRY DATE: 2019-04-01
  ref <313>: RELEVANT RESIDUES IN SEQ ID NO: (1)..(1541)
tttaactgaagagtttgatcatggctcagattgaacgctggcggcaggcttaacacatgcaagtcgagcggggatagggtgcttgcacctgattcctagcggcggacgggtgagtaatgcttaggaatctgcctattagtgggggacaacgttccgaaagggacgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggcttacctggttaatacctgggataagtggacgttactcgcagaataagcaccggctaactctgtgccagcagccgcggtaatacagagggtgcaagcgttaatcggatttactgggcgtaaagcgcgcgtaggtggctaattaagtcaaatgtgaaatccccgagcttaacttgggaattgcattcgatactggttagctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcccttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatacagagaactttccagagatggattggtgccttcgggaactctgatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacggccagggctacacacgtgctacaatggtcggtacaaagggttgctactgcgcgagcagatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccttagggaggacgcttaccacggtgtggccgatgactggggtgaagtcgtaacaaggtagccgtaggggaacctgcggctggatcacctccttaa

SEQ ID NO: 1080 - DNA, 1542 bp, Acinetobacter wuhouensis
  ref <308>: DATABASE ACCESSION NUMBER: NCBI ACCESSION: NZ_CP033133.1
  ref <309>: DATABASE ENTRY DATE: 2019-04-01
  ref <313>: RELEVANT RESIDUES IN SEQ ID NO: (1)..(1542)
tttaactgaagagtttgatcatggctcagattgaacgctggcggcaggcttaacacatgcaagtcgagcgggggaggttgcttcggtaactgacctagcggcggacgggtgagtaatacttaggaatctgcctattagtgggggacaacgtttcgaaaggaacgctaataccgcatacgtcctacgggagaaagcaggggatcacttgtgaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggagctcttggttaatacccaagatgcttggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtagaaactttccagagatggattggtgccttcgggaatctacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctccttaa

SEQ ID NO: 1081 - DNA, 1470 bp, Actibacterium atlanticum
  ref <308>: DATABASE ACCESSION NUMBER: NCBI ACCESSION: NZ_AQQY01000019.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcttaacacatgcaagtcgagcgcaccttcgggtgagcggcggacgggtgagtaacgcgtgggaacgtgcccttttctgcggaatagcctctggaaacggagagtaataccgcatacgcccttcgggggaaagatttatcggagaaggatcggcccgcgttagattagatagttggtggggtaatggcctaccaagtctacgatctatagctggtttgagaggatgatcagccacactgggactgagacacggcccagactcctacgggaggcagcagtgaggaatcttggacaatgggggaaaccctgatccagccatgccgcgtgagtgatgaaggccttagggtcgtaaagctctttcgcctgggatgataatgacagtaccaggtaaagaaaccccggctaactccgtgccagcagccgcggtaatacggagggggttagcgttgttcggaattactgggcgtaaagcgcacgtaggcggactgttaagttagaggtgaaatcccggggctcaaccccggaactgcctttaatactggcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttacgagagatcgtttccttcagttcggctggatcagtgacaggtgctgcatggctgtcgtcagctcgtgtcgtgagatgttcggttaagtccggcaacgagcgcaacccacgtccttagttgccagcagttcggctgggcactctagggaaactgccgatgataagtcggaggaaggtgtggatgacgtcaagtcctcatggcccttacgggttgggctacacacgtgctacaatggcagtgacaatgggttaatccctaaaaactgtctcagttcggattgtcctctgcaactcgagggcatgaagtcggaatcgctagtaatcgcgtaacagcatgacgcggtgaatacgttcccgggccttgtacacaccgcccgtcacaccatgggagttggttctacccgacgacgctgcgctaacctttcgagggggcaggcggccacggtaggatcagcgactggggtgaagtcgtaacaaggtagccgtaggggaacctgcggctggatcacctcctttctaa

SEQ ID NO: 1082 - DNA, 1469 bp, Actibacterium mucosum
  ref <308>: DATABASE ACCESSION NUMBER: NCBI ACCESSION: NZ_JFKE01000018.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcttaacacatgcaagtcgagcgcaccttcgggtgagcggcggacgggtgagtaacgcgtgggaacgtgcccttttctgcggaatagcctctggaaacggagagtaataccgcatacgcccttcgggggaaagaatttcggagaaggatcggcccgcgttagattaggtagttggtggggtaacggcctaccaagccgacgatctatagctggtttgagaggatgatcagccacactgggactgagacacggcccagactcctacgggaggcagcagtgaggaatcttggacaatggacgcaagtctgatccagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggactgttaagtcagaggtgaaatcccggggctcaaccccggaactgcctttgatactggcagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttgtcgcggttaccagagatggtttccttcagttcggctggacaagtgacaggtgctgcatggctgtcgtcagctcgtgtcgtgagatgttcggttaagtccggcaacgagcgcaacccacgtccttagttgccagcagttaggctgggcactctagggaaactgccgatgataagtcggaggaaggtgtggatgacgtcaagtcctcatggcccttacgggttgggctacacacgtgctacaatggcaactacagtgggttaatccccaaaagttgtctcagttcggattgttctctgcaactcgagagcatgaagtcggaatcgctagtaatcgcgtaacagcatgacgcggtgaatacgttcccgggccttgtacacaccgcccgtcacaccatgggagttggttctacccgacgacgctgcgctaacctttcgagggggcaggcggccacggtaggatcagcgactggggtgaagtcgtaacaaggtagccgtaggggaacctgcggctggatcacctcctttctaa

SEQ ID NO: 1083 - DNA, 1471 bp, Actibacterium ureilyticum
  ref <308>: DATABASE ACCESSION NUMBER: NCBI ACCESSION: NZ_NSBT01000025.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcttaacacatgcaagtcgagcgaagacttcggtcttagcggcggacgggtgagtaacgcgtgggaacgtgcccttctctacggaacagtcctgggaaactgggtttaataccgtatacgcccttcgggggaaagaatttcggagagggatcggcccgcgttagattaggtagttggtggggtaacggcctaccaagccgacgatctatagctggtttgagaggatgatcagccacactgggactgagacacggcccagactcctacgggaggcagcagtgaggaatcttggacaatggacgcaagtctgatccagccatgccgcgtgagtgatgaaggccctagggtcgtaaagctctttcgcctgtgatgataatgacagtagcaggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcccttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttgtcgcggttaccagagatggtttccttcagttcggctggacaagtgacaggtgctgcatggctgtcgtcagctcgtgtcgtgagatgttcggttaagtccggcaacgagcgcaacccacgttcttagttgccagcagttcggctgggcactctaagaaaactgccgatgataagtcggaggaaggtgtggatgacgtcaagtcctcatggcccttacgggttgggctacacacgtgctacaatggtaatgacaatgggttaatccccaaaagttatctcagttcggattgtcctctgcaactcgagggcatgaagtcggaatcgctagtaatcgcgtaacagcatgacgcggtgaatacgttcccgggccttgtacacaccgcccgtcacaccatgggagttggttctacccgacggccgtgcgctaacctttcgaggaggcagcggaccacggtaggatcagcgactggggtgaagtcgtaacaaggtagccgtaggggaacctgcggctggatcacctcctttctaa

SEQ ID NO: 1084 - DNA, 1557 bp, Actinobacillus delphinicola
  ref <308>: DATABASE ACCESSION NUMBER: NCBI ACCESSION: NZ_LR134510.1
  ref <309>: DATABASE ENTRY DATE: 2019-04-01
  ref <313>: RELEVANT RESIDUES IN SEQ ID NO: (1)..(1557)
ttgaattgaagagtttgatcatggctcagattgaacgctggcggcaggcttaacacatgcaagtcgaacggtaacaggaagaaagcttgctttctttgctgacgagtggcggacgggtgagtaatgcttgggaatctgtttcatggagggggataactacgggaaactgtagctaataccgcgtaatatcgagagattaaatgtgtgggaccgcaaggccacatgccatgaagtgagcccaagtgggattagatagttggtgaggtaatggctcaccaagtcagcgatctctagctggtctgagaggatgaccagccacactgggactgagacacggcccagactcctacgggaggcagcagtggggaatattgcacaatgggcgcaagcctgatgcagccatgccgcgtgaatgaagaaggccttcgggttgtaaagttctttcggtggtgaggaaggttggcgtgttaatagcacgttgacttgacgttagccacagaagaagcaccggctaactccgtgccagcagccgcggtaatacggagggtgcgagcgttaatcggaataactgggcgtaaagggcacgcaggcggtgacttaagtgaggtgtgaaagccctgggcttaacctaggaattgcatttcatactgggtcgctagagtattttagggaggggtagaattccacgtgtagcggtgaaatgcgtagagatgtggaggaataccgaaggcgaaggcagccccttgggaatatactgacgctcatgtgcgaaagcgtggggagcaaacaggattagataccctggtagtccacgctgtaaacgatgtcgatttggggattgggctttaggtctggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaaccttgtagagatacgagggtgccttcgggaaccatgagacaggtgctgcatggctgtcgtcagctcgtgttgtgaaatgttgggttaagtcccgcaacgagcgcaacccttatcctttgttgccagcggtttggccgggaactcaaaggagactgccagtgataaactggaggaaggtggggatgacgtcaagtcatcatggcccttacgagtagggctacacacgtgctacaatggcgtatacagagggcagcgagcctgcgagggtgagcgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttcgggagggcgtttaccacggtatgattcatgactggggtgaagtcgtaacaaggtaaccgtaggggaacctgcggttggatcacctccttaccaaaatgaagc

SEQ ID NO: 1085 - DNA, 1546 bp, Actinobacillus lignieresii
  ref <308>: DATABASE ACCESSION NUMBER: NCBI ACCESSION: NZ_LR134169.1
  ref <309>: DATABASE ENTRY DATE: 2019-04-01
  ref <313>: RELEVANT RESIDUES IN SEQ ID NO: (1)..(1546)
ttgaattgaagagtttgatcatggctcagattgaacgctggcggcaggcttaacacatgcaagtcgaacggtaacgggaagggagcttgctttctttgccgacgagtggcggacgggtgagtaatgcttgggaatctggcttatggagggggataactacgggaaactgtggctaataccgcgtaatatcttaggattaaagggtgggactttcgggccacctgccataagatgagcccaagtgggattaggtagttggttaggtaaaggctgaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggtatcaaatttaatagatttggtaattgacgttaactacagaagaagcaccggctaactccgtgccagcagccgcggtaatacggagggtgcgagcgttaatcggaataactgggcgtaaagggcacgcaggcggttgattaagtgagatgtgaaagccccgagcttaacttgggaattgcatttcatactggtcaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattggactgtgagtctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggaagcaagatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccgaaaggggggcgtttaccacggtatgattcatgactggggtgaagtcgtaacaaggtaaccgtaggggaacctgcggttggatcacctccttact

SEQ ID NO: 1086 - DNA, 1561 bp, Actinobacteria bacterium YIM 96077
  ref <308>: DATABASE ACCESSION NUMBER: NCBI ACCESSION: NZ_CP033729.1
  ref <309>: DATABASE ENTRY DATE: 2019-04-01
  ref <313>: RELEVANT RESIDUES IN SEQ ID NO: (1)..(1561)
tggagagtttgatcctggctcaggacgaacgctggcggcgtgccttacacatgcaagtcgagcgatcggcccggtcctccgggaccgggtacggagcggcgaacgggtgagtaacacgtgagcaacctacctctggcaccgggataaccccgggaaactggggctaataccggataaccatcggccggggcatctcggccgatgcaaatggttccgatctctgatcggttctggccagggatgggctcgcggcccatcagtctgatggtggggtaacggcccaccaaggcgacgacgggtagccggcctgagagggtgatcggccacactgggactgagatacggcccagactcctacgggaggcagcagtggggaatattgcacaatgggcgaaagcctgatgcagcaacgccgcgtgagggatgacagccttcgggttgtaaacctctttcggcgccgacgaagccctgattcgtcaggacagggtgactgtaggcgcagaagaagcaccggccaactacgtgccagcagccgcggtaatacgtagggtgcaagcgttgtccggaattactgggcgtaaagagctcgtaggcggtctgtcgcgtcggctgtgaaatgtcggggctcaaccccggaactgcagccgatacgggcagactagaggacggcaggggcaagtggaattcctggtgtagcggtgaaatgcgcagatatcaggaggaactccgctggcgaaggcagcttgctgggccgatcctgacgctgaggagcgaaagcgtggggagcgaacaggattagataccctggtagtccacgccgtaaacgttgggcgctaggtgtggggaatgaccatattctccgcgccgtagctaacgcgttaagcgccccgcctggggagtacggccgcaaggctaaaactcaaaggaattgacgggggctcgcacaagcggcggggcatgcggattaattcgatgcaacgcgaagaaccttacctgggtttgacatgccgggaaatcttccagagatgggaggtgccttagggcgcccggcacaggtggtgcatggctgtcgtcagctcgtgtcgtgagatgttgggttaagtcccgtaacgagcgcaacccttgtcccatgttgccagcggttcggccggggactcatgggagaccgccggggccaactcggaggaaggcggggatgacgtcaagtcatcatgcccctgatgcccagggcttcacgcatgccacaatggccggtacaaagggcagcgataccgcaaggtggagcgaatcccagaaaaccggtctcagttcggatcggggtctgcaactcgaccccgtgaagtcggagtcgctagtaatcgcagatcagcaacgctgcggtgaatacgttcccgggccttgtacacaccgcccgtcacgtactgggagtcggcaacgcccgaagccggtggcccaaccccgttctacggggagggagccgtcgaaggcggggctggcgactagtacgaagtcgtaacaaggtagccgtaccggaaggtgcggctggatcacctcctttcta

SEQ ID NO: 1087 - DNA, 1551 bp, Actinobaculum sp. 313
  ref <308>: DATABASE ACCESSION NUMBER: NCBI ACCESSION: NZ_CP029033.1
  ref <309>: DATABASE ENTRY DATE: 2019-04-01
  ref <313>: RELEVANT RESIDUES IN SEQ ID NO: (1)..(1551)
tttgtggagagtttgatcctggctcaggacgaacgctggcggcgtgcttaacacatgcaagtcgaacgggctcattctggctttttggttggggtgggttagtggcgaacgggtgagtaatacgtgagtaacctgccctcttcttcgggataagctttggaaacggggtctaataccgggtattcccttggtgtcgcatggtgctgggggaaagggtttttctggtgggggatgggctcgcggcctatcagcttgttggtggggtgatggcctaccaaggcgtcgacgggtagccggcctgagagggtgaccggccacattgggactgagatacggcccagactcctacgggaggcagcagtgggggatattgcacaatgggcgcaagcctgatgcagcgacgccgcgtgggggatgaaggctttcgggttgtaaacctctttcggcaggggacaaggctgctcgtttgggtggttgagggtacctgtagaagaagcgccggctaactacgtgccagcagccgcggtaatacgtagggcgcgagcgttgtccggaattattgggcgtaaagggctcgtaggcggtttgttgcgtctgctgtgaaaacgcggggcttaacttcgcgcgtgcagtgggtacgggcaggctggagtgcggtaggggtggctggaattcccggtgtagcggtggaatgcgcagatatcgggaggaacaccgatggcgaaggcaggtcactgggccgttactgacgctgaggagcgaaagcatggggagcgaacaggattagataccctggtagtccatgctgtaaacgttgggcactaggtgtggggcttgtttgtgggttctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcgtcgggatcgtgcagagatgtgcgggtctttggactggcgtgcaggtggtgcatggttgtcgtcagctcgtgtcgtgagatgttgggttaagtcccgcaacgagcgcaacccttgtctcgtgttgccagcatttggttggggactcacgggagactgccggggttaactcggaggaaggtggggatgacgtcaaatcatcatgccccttatgtcttgggcttcacgcatgctacaatggccggtacagagggttgcgatatcgtgaggtggagcgaatctcttaaagctggtctcagttcggatcgtagtctgcaactcgactacgtgaagtcggagtcgctagtaatcgcggatcagcaacgccgcggtgaatacgttctcgggccttgtacacaccgcccgtcacgtcacgaaagttggcaacacccgaagctcgtggcctaactgcttttttggtggggggagcggtcgaaggtggggttggcgattgggacgaagtcgtaacaaggtagccgtaccggaaggtgcggctggatcacctcctttctagggag

SEQ ID NO: 1088 - DNA, 1550 bp, Actinobaculum sp. 352
  ref <308>: DATABASE ACCESSION NUMBER: NCBI ACCESSION: NZ_RQSN01000023.1
  ref <309>: DATABASE ENTRY DATE: 2019-04-01
  ref <313>: RELEVANT RESIDUES IN SEQ ID NO: (1)..(1550)
tgtggagagtttgatcctggctcaggacgaacgctggcggcgtgcttaacacatgcaagtcgaacgggctcattctggctttttggttggggtgggttagtggcgaacgggtgagtaatacgtgagtaacctgccctcttcttcgggataagctttggaaacggggtctaataccgggtattcccttggtgtcgcatggtgctggggggaaagggtttttctggtgggggatgggctcgcggcctatcagcttgttggtggggtgatggcctaccaaggcgtcgacgggtagccggcctgagagggtgaccggccacattgggactgagatacggcccagactcctacgggaggcagcagtgggggatattgcacaatgggcgcaagcctgatgcagcgacgccgcgtgggggatgaaggctttcgggttgtaaacctctttcggcaggggacaaggctgctcgtttgggtggttgagggtacctgtagaagaagcgccggctaactacgtgccagcagccgcggtaatacgtagggcgcgagcgttgtccggaattattgggcgtaaagggctcgtaggcggtttgttgcgtctgctgtgaaaacgcggggcttaacttcgcgcgtgcagtgggtacgggcaggctggagtgcggtaggggtggctggaattcccggtgtagcggtggaatgcgcagatatcgggaggaacaccgatggcgaaggcaggtcactgggccgttactgacgctgaggagcgaaagcatggggagcgaacaggattagataccctggtagtccatgctgtaaacgttgggcactaggtgtggggcttgtttgtgggttctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcgtcgggatcgtgcagagatgtgcgggtctttggactggcgtgcaggtggtgcatggttgtcgtcagctcgtgtcgtgagatgttgggttaagtcccgcaacgagcgcaacccttgtctcgtgttgccagcatttggttggggactcacgggagactgccggggttaactcggaggaaggtggggatgacgtcaaatcatcatgccccttatgtcttgggcttcacgcatgctacaatggccggtacagagggttgcgatatcgtgaggtggagcgaatctcttaaagctggtctcagttcggatcgtagtctgcaactcgactacgtgaagtcggagtcgctagtaatcgcggatcagcaacgccgcggtgaatacgttctcgggccttgtacacaccgcccgtcacgtcacgaaagttggcaacacccgaagctcgtggcctaactgcttttttggtggggggagcggtcgaaggtggggttggcgattgggacgaagtcgtaacaaggtagccgtaccggaaggtgcggctggatcacctcctttctagggag

SEQ ID NO: 1089 - DNA, 1515 bp, Actinocorallia herbida
  ref <308>: DATABASE ACCESSION NUMBER: NCBI ACCESSION: NZ_RJKE01000001.1
  ref <309>: DATABASE ENTRY DATE: 2019-04-01
  ref <313>: RELEVANT RESIDUES IN SEQ ID NO: (1)..(1515)
tggagagtttgatcctggctcaggacgaacgctggcggcgtgcttaacacatgcaagtcgagcggaaaggcccttcggggtactcgagcggcgaacgggtgagtaacacgtgagcaacctgcccccgactctgggataagcccgggaaactgggtctaataccggatacgacaccgatcggcatcggttggtgtggaaagtttttcggttggggatgggctcgcggcctatcagcttgttggtggggtagtggcccaccaaggcgacgacgggtagccggcctgagagggcgaccggccacactgggactgagacacggcccagactcctacgggaggcagcagtggggaatattgcacaatgggggaaaccctgatgcagcgacgccgcgtgcgggatgacggccttcgggttgtaaaccgctttcagcagggacgaatcaagacggtacctgcagaagaagcgccggctaactacgtgccagcagccgcggtaatacgtagggcgcaagcgttgtccggaattattgggcgtaaagagctcgtaggcggcttgtcgcgtcgggtgtgaaagcccacggcttaaccgtgggtctgcatccgatacgggcaggctagaggcaggtaggggagaacggaattcccggtgtagcggtgaaatgcgcagatatcgggaggaacaccggtggcgaaggcggttctctgggcctgtactgacgctgaggagcgaaagcgtggggagcgaacaggattagataccctggtagtccacgccgtaaacgttgggcgctaggtgtggggaccttccacggtttccgcgccgcagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacatcgccggaaaactcgcagagatgcggggtccttttgggccggtgacaggtggtgcatggctgtcgtcagctcgtgtcgtgagatgttgggttaagtcccgcaacgagcgcaaccctcgttccatgttgccagcacgtaatggtggggactcatgggagactgccggggtcaactcggaggaaggtggggatgacgtcaagtcatcatgccccttatgtcttgggctgcaaacatgctacaatggccggtacagagggctgcgataccgcaaggtggagcgaatcccttaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcagcaacacccgaagcccgtggcccaacccgcaagggagggagcggtcgaaggtggggccggcgattgggacgaagtcgtaacaaggtagccgtaccggaaggtgcggctggatcacctcctttctaaggag

SEQ ID NO: 1090 - DNA, 1526 bp, Actinokineospora cianjurensis
  ref <308>: DATABASE ACCESSION NUMBER: NCBI ACCESSION: NZ_RCDD01000016.1
  ref <309>: DATABASE ENTRY DATE: 2019-04-01
  ref <313>: RELEVANT RESIDUES IN SEQ ID NO: (1)..(1526)
tctttggagagtttgatcctggctcaggacgaacgctggcggcgtgcttaacacatgcaagtcgagcggtaaggcccttcggggtacacgagcggcgaacgggtgagtaacacgtgggtaatctgccccatactctgggataagccttggaaacgaggtctaataccggatatgaccccgcaccgcatggtgtggggtggaaagttccggcggtatgggatgaacccgcggcctatcagcttgttggtggggtagtggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcgagcgttgtccggaattattgggcgtaaagagctcgtaggcggtttgtcgcgtcggccgtgaaaacctgcagcttaactgtgggcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacggtgggtgctaggtgtggggaccattccacggtttccgtgccgtagctaacgcattaagcaccccgcctggggagtacggccgcaaggctaaaactcaaaggaattgacgggggcccgcacaagcggcggagcatgtggattaattcgatgcaacgcgaagaaccttacctgggcttgacatgcattggaaaccggtagagatatcggcccccttgtggccggtgcacaggtggtgcatggctgtcgtcagctcgtgtcgtgagatgttgggttaagtcccgcaacgagcgcaaccctcgttccatgttgccagcacgtaatggtggggactcatgggagactgccggggtcaactcggaggaaggtggggatgacgtcaagtcatcatgccccttatgtccagggcttcacacatgctacaatggccggtacagagggctgcgagaccgcgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccatggcccaacccgcaagggggggagtggtcgaaggtgggactggcgattgggacgaagtcgtaacaaggtagccgtaccggaaggtgcggctggatcacctcctttctaaggag

SEQ ID NO: 1091 - DNA, 1522 bp, Actinomadura amylolytica
  ref <308>: DATABASE ACCESSION NUMBER: NCBI ACCESSION: NZ_CP032402.1
  ref <309>: DATABASE ENTRY DATE: 2019-04-01
  ref <313>: RELEVANT RESIDUES IN SEQ ID NO: (1)..(1522)
tggagagtttgatcctggctcaggacgaacgctggcggcgtgcttaacacatgcaagtcgagcggaaaggccccttcgggggtactcgagcggcgaacgggtgagtaacacgtgagcaacctgcccccgactctgggataagcctgggaaaccgggtctaataccggatacgaccactgctcgcatgggtggtggtggaaagttttttcggtcggggatgggctcgcggcctatcagcttgttggtggggtgatggcctaccaaggcgacgacgggtagccggcctgagagggcgaccggccacactgggactgagacacggcccagactcctacgggaggcagcagtggggaatattgcgcaatgggcggaagcctgacgcagcgacgccgcgtgggggatgaaggccttcgggttgtaaacctctttcagcaccgacgaattttggacggtaggtgcagaagaagcgccggctaactacgtgccagcagccgcggtaatacgtagggcgcaagcgttgtccggaattattgggcgtaaagagctcgtaggcggcctgtcgcgtccgtcgtgaaagcccacggctcaaccgtgggtctgcggtggatacgggcaggctagaggcaggtaggggagaacggaattcccggtgtagcggtgaaatgcgcagatatcgggaggaacaccggtggcgaaggcggttctctgggcctgttctgacgctgaggagcgaaagcgtggggagcgaacaggattagataccctggtagtccacgccgtaaacgttgggcgctaggtgtggggttcttccacgggctccgcgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacatcgcccgttcacctgcagagatgtggggtcccttcgggggcgggtgacaggtggtgcatggctgtcgtcagctcgtgtcgtgagatgttgggttaagtcccgcaacgagcgcaaccctcgttccatgttgccagcacgtgatggtggggactcatgggagaccgccggggtcaactcggaggaaggtggggatgacgtcaagtcatcatgccccttatgtcttgggctgcaaacatgctacaatggccggtacagagggctgcgataccgtgaggtggagcgaatccctaaaagccggtctcagttcggatcgaagtctgcaactcgacttcgtgaagtcggagtcgctagtaatcgcagatcagcaacgctgcggtgaatacgttcccgggccttgtacacaccgcccgtcacgtcacgaaagtcggcaacacccgaagcccgtggcccaacccttcgtgggggggagcggtcgaaggtggggccggcgattgggacgaagtcgtaacaaggtagccgtaccggaaggtgcggctggatcacctcctttctaaggag

SEQ ID NO: 1092 - DNA, 1535 bp, Actinomadura pelletieri
  ref <308>: DATABASE ACCESSION NUMBER: NCBI ACCESSION: NZ_RBWU01000012.1
  ref <309>: DATABASE ENTRY DATE: 2019-04-01
  ref <313>: RELEVANT RESIDUES IN SEQ ID NO: (1)..(1535)
aatggagagtttgatcctggctcaggacgaacgctggcggcgtgcttaacacatgcaagtcgagcggaaaggccccttcgggggtactcgagcggcgaacgggtgagtaacacgtgagtaacctgcccctgacttcgggataagcctgggaaaccgggtctaataccggatatgactttctcgtgcatgcgggagggtggaaagttttttcggttggggatgggctcgcggcctatcagcttgttggtggggtgatggcctaccaaggcttcgacgggtaaccggcctgagagggcgaccggtcacactgggactgagacacggcccagactcctacgggaggcagcagtggggaatattgcgcaatgggcggaagcctgacgcagcgacgccgcgtgggggatgacggccttcgggttgtaaacctctttcagcagggacgaagggcttcggtttgacggtacctgcagaagaagcgccggctaactacgtgccagcagccgcggtaatacgtagggcgcaagcgttgtccggaattattgggcgtaaagagctcgtaggcggtttgttgcgtctgtcgtgaaagcccacggcttaaccgtgggtttgcggtggatacgggcagactagaggcaggtaggggagaatggaattcccggtgtagcggtgaaatgcgcagatatcgggaggaacaccggtggcgaaggcggttctctgggcctgtactgacgctgaggagcgaaagcgtggggagcgaacaggattagataccctggtagtccacgccgtaaacgttgggcgctaggtgtggggttcttccacggattccgcgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacatcgccggaaatccatcggagacggtgggtcctttttgggtcggtgacaggtggtgcatggctgtcgtcagctcgtgtcgtgagatgttgggttaagtcccgcaacgagcgcaaccctcgttccatgttgccagcaacaccttcgggtggttggggactcatgggagaccgccggggtcaactcggaggaaggtggggatgacgtcaagtcatcatgccccttatgtcttgggctgcaaacatgctacaatggccggtacagagggctgcgataccgtgaggtggagcgaatcccgtaaagccggtctcagttcggatcgaagtctgcaactcgacttcgtgaagtcggagtcgctagtaatcgcagatcagcaacgctgcggtgaatacgttcccgggccttgtacacaccgcccgtcacgtcacgaaagtcggcaacacccgaagcccgtggcccaacccttgtggggggagcggtcgaaggtggggccggcgattgggacgaagtcgtaacaaggtagccgtaccggaaggtgcggctggatcacctcctttctaaggag

SEQ ID NO: 1093 - DNA, 1535 bp, Actinomadura sp. LHW52907
  ref <308>: DATABASE ACCESSION NUMBER: NCBI ACCESSION: NZ_QVNQ01000023.1
  ref <309>: DATABASE ENTRY DATE: 2019-04-01
  ref <313>: RELEVANT RESIDUES IN SEQ ID NO: (1)..(1535)
tggagagtttgatcctggctcaggacgaacgctggcggcgtgcttaacacatgcaagtcgagcggaaaggccccttcgggggtactcgagcggcgaacgggtgagtaacacgtgagtaacctgcccctgacttcgggataagcctgggaaactgggtctaataccggatatgactttctcgtgcatgcgggagggtggaaagttttttcggttggggatgggctcgcggcctatcagcttgttggtggggtgatggcctaccaaggcttcgacgggtaaccggcctgagagggcgaccggtcacactgggactgagacacggcccagactcctacgggaggcagcagtggggaatattgcgcaatgggcggaagcctgacgcagcgacgccgcgtgggggatgacggccttcgggttgtaaacctctttcagcagggacgaagggcctttgggtttgacggtacctgcagaagaagcgccggctaactacgtgccagcagccgcggtaatacgtagggcgcaagcgttgtccggaattattgggcgtaaagagctcgtaggcggtttgttgcgtccgtcgtgaaagcccacggcttaaccgtgggtttgcggtggatacgggcagactagaggcaggtaggggagaatggaattcccggtgtagcggtgaaatgcgcagatatcgggaggaacaccggtggcgaaggcggttctctgggcctgtactgacgctgaggagcgaaagcgtggggagcgaacaggattagataccctggtagtccacgccgtaaacgttgggcgctaggtgtggggttcttccacggattccgcgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacatcgccggaaatccatcggagacggtgggtcctttttgggtcggtgacaggtggtgcatggctgtcgtcagctcgtgtcgtgagatgttgggttaagtcccgcaacgagcgcaaccctcgttccatgttgccagcaacaccttcgggtggttggggactcatgggagaccgccggggtcaactcggaggaaggtggggatgacgtcaagtcatcatgccccttatgtcttgggctgcaaacatgctacaatggccggtacagagggctgcgataccgtgaggtggagcgaatcccttaaagccggtctcagttcggatcgaagtctgcaactcgacttcgtgaagtcggagtcgctagtaatcgcagatcagcaacgctgcggtgaatacgttcccgggccttgtacacaccgcccgtcacgtcacgaaagtcggcaacacccgaagcccgtggcccaacccttgtggggggagcggtcgaaggtggggccggcgattgggacgaagtcgtaacaaggtagccgtaccggaaggtgcggctggatcacctcctttctaaggag

SEQ ID NO: 1094 - DNA, 1535 bp, Actinomadura sp. NEAU-G17
  ref <308>: DATABASE ACCESSION NUMBER: NCBI ACCESSION: NZ_QURH01000560.1
  ref <309>: DATABASE ENTRY DATE: 2019-04-01
  ref <313>: RELEVANT RESIDUES IN SEQ ID NO: (1)..(1535)
tgatggagagtttgatcctggctcaggacgaacgctggcggcgtgcttaacacatgcaagtcgagcggaaaggccccttcgggggtactcgagcggcgaacgggtgagtaacacgtgagcaacctgcccctgactctgggataagcccgggaaactgggtctaataccggatgtgaccactcaaggcatcttgtggtggtggaaagttttttcggtcagggatgggctcgcggcctatcagcttgttggtggggtgatggcctaccaaggcgacgacgggtaaccggcctgagagggcgaccggtcacactgggactgagacacggcccagactcctacgggaggcagcagtggggaatattgcgcaatgggcggaagcctgacgcagcgacgccgcgtgggggatgacggccttcgggttgtaaacccctttcagcagggacgaagggtgactgacggtacctgcagaagaagcgccggctaactacgtgccagcagccgcggtaatacgtagggcgcaagcgttgtccggaattattgggcgtaaagagctcgtaggcggtctgtcgcgtcgggtgtgaaagcccacggcttaaccgtgggtctgcattcgatacgggcagactagaggcaggtaggggagcatggaattcccggtgtagcggtgaaatgcgcagatatcgggaggaacaccggtggcgaaggcggtgctctgggcctgtactgacgctgaggagcgaaagcgtggggagcgaacaggattagataccctggtagtccacgccgtaaacgttgggcgctaggtgtggggtccttccacggattccgcgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacatcgcccgtgcccctgcagagatgcaggttccttttgggcgggtgacaggtggtgcatggctgtcgtcagctcgtgtcgtgagatgttgggttaagtcccgcaacgagcgcaaccctcgttccatgttgccagcacgctccttcgggggtggtggggactcatgggagaccgccggggtcaactcggaggaaggtggggatgacgtcaagtcatcatgccccttatgtcttgggctgcaaacatgctacaatggccggtacagagggctgcgataccgtgaggtggagcgaatcccttaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagcccgtggcccaacccgtaagggggggagcggtcgaaggtggggccggcgattgggacgaagtcgtaacaaggtagccgtaccggaaggtgcggctggatcacctcctttctaaggag

SEQ ID NO: 1095 - DNA, 1534 bp, Actinomadura sp. NEAU-Ht49
  ref <308>: DATABASE ACCESSION NUMBER: NCBI ACCESSION: NZ_RFFG01000256.1
  ref <309>: DATABASE ENTRY DATE: 2019-04-01
  ref <313>: RELEVANT RESIDUES IN SEQ ID NO: (1)..(1534)
tgatggagagtttgatcctggctcaggacgaacgctggcggcgtgcttaacacatgcaagtcgagcggaaaggccccttcgggggtactcgagcggcgaacgggtgagtaacacgtgagcaacctgcccctgactctgggataagcccgggaaactgggtctaataccggatatgaccattcaacgcatgttgtggtggtggaaagtttttcggttggggatgggctcgcggcctatcagcttgttggtggggtgatggcctaccaaggcgacgacgggtaaccggcctgagagggcgaccggtcacactgggactgagacacggcccagactcctacgggaggcagcagtggggaatattgcgcaatgggcgaaagcctgacgcagcgacgccgcgtgggggatgacggccttcgggttgtaaacccctttcagcagggacgaagggtgactgacggtacctgcagaagaagcgccggctaactacgtgccagcagccgcggtaatacgtagggcgcaagcgttgtccggaattattgggcgtaaagagctcgtaggcggtttgtcgcgtcgggtgtgaaagcccacggcttaaccgtgggtctgcattcgatacgggcagactagaggcaggtaggggagcatggaattcccggtgtagcggtgaaatgcgcagatatcgggaggaacaccggtggcgaaggcggtgctctgggcctgtactgacgctgaggagcgaaagcgtggggagcgaacaggattagataccctggtagtccacgccgtaaacgttgggcgctaggtgtggggtccttccacggattccgcgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacattgcccatgtccctgcagagatgcaggttcctttagtgggtgggtgacaggtggtgcatggctgtcgtcagctcgtgtcgtgagatgttgggttaagtcccgcaacgagcgcaaccctcgttccatgttgccagcacgcccttcggggtggtggggactcatgggagaccgccggggtcaactcggaggaaggtggggatgacgtcaagtcatcatgccccttatgtcttgggctgcaaacatgctacaatggccggtacagagggctgcgataccgtaaggtggagcgaatcccttaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcagcaacacccgaagcccgtggcccaaccagcaatggggggagcggtcgaaggtggggccggcgattgggacgaagtcgtaacaaggtagccgtaccggaaggtgcggctggatcacctcctttctaaggag

SEQ ID NO: 1096 - DNA, 1527 bp, Actinomadura sp. WAC 06369
  ref <308>: DATABASE ACCESSION NUMBER: NCBI ACCESSION: NZ_QHJN01000296.1
  ref <309>: DATABASE ENTRY DATE: 2019-04-01
  ref <313>: RELEVANT RESIDUES IN SEQ ID NO: (1)..(1527)
ttaatggagagtttgatcctggctcaggacgaacgctggcggcgtgcttaacacatgcaagtcgagcggaaaggccccttcgggggtactcgagcggcgaacgggtgagtaacacgtgagcaacctgcccttgactctgggataagcccgggaaaccaggtctaataccggatacgaccatctctctcctgtgatgatggtggaaagatttatcggtcagggatgggctcgcggcctatcagcttgttggtggggtaacggcctaccaaggcgacgacgggtaaccggcctgagagggcgaccggtcacactgggactgagacacggcccagactcctacgggaggcagcagtggggaatattgcgcaatgggcgaaagcctgacgcagcgacgccgcgtgagggatgacggccttcgggttgtaaacctctttcagcagggacgaagcgaaagtgacggtacctgcagaagaagcgccggctaactacgtgccagcagccgcggtaatacgtagggcgcaagcgttgtccggaattattgggcgtaaagagctcgtaggcggtctgtcgcgtctgtcgtgaaagcccacggcttaaccgtgggtctgcggtggatacgggcagactagaggcaggtaggggagaatggaattcccggtgtagcggtgaaatgcgcagatatcgggaggaacaccggtggcgaaggcggttctctgggcctgtactgacgctgaggagcgaaagcgtggggagcgaacaggattagataccctggtagtccacgccgtaaacgttgggcgctaggtgtggggttcttccacggattccgcgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacatcgccggaaatccatcagagatggtgggtcctttttgggccggtgacaggtggtgcatggctgtcgtcagctcgtgtcgtgagatgttgggttaagtcccgcaacgagcgcaaccctcgttccatgttgccagcacgtaatggtggggactcatgggagaccgccggggtcaactcggaggaaggtggggatgacgtcaagtcatcatgccccttatgtcttgggctgcaaacatgctacaatggccggtacagagggctgcgaaaccgtgaggtggagcgaatcccttaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagcccgtggcccaacccttgtggggggagcggtcgaaggtggggccggcgattgggacgaagtcgtaacaaggtagccgtaccggaaggtgcggctggatcacctcctttctaaggag

SEQ ID NO: 1097 - DNA, 1519 bp, Actinomadura umbrina
  ref <308>: DATABASE ACCESSION NUMBER: NCBI ACCESSION: NZ_QTTT01000001.1
  ref <309>: DATABASE ENTRY DATE: 2019-04-01
  ref <313>: RELEVANT RESIDUES IN SEQ ID NO: (1)..(1519)
ttgatggagagtttgatcctggctcaggacgaacgctggcggcgtgcttaacacatgcaagtcgagcggaaaggcccttcggggtactcgagcggcgaacgggtgagtaacacgtgagcaacctgcccccgacttcgggataagcctgggaaaccgggtctaataccggatacgacctccactcgcatgggtggtggtggaaagttcttcggtcggggatgggctcgcggcctatcagcttgttggtggggtgatggcctaccaaggcgacgacgggtagccggcctgagagggcgaccggccacactgggactgagacacggcccagactcctacgggaggcagcagtggggaatattgcgcaatgggcgaaagcctgacgcagcgacgccgcgtgggggatgaaggccttcgggttgtaaacctctttcaccaccgacgaaaccagacggtaggtggggaagaagcgccggctaactacgtgccagcagccgcggtaatacgtagggcgcaagcgttgtccggaattattgggcgtaaagagctcgtaggcggcctgtcgcgtccgtcgtgaaagcccacggctcaaccgtgggtctgcggtggatacgggcaggctagaggcaggtaggggagaacggaattcccggtgtagcggtgaaatgcgcagatatcgggaggaacaccggtggcgaaggcggttctctgggcctgtactgacgctgaggagcgaaagcgtggggagcgaacaggattagataccctggtagtccacgccgtaaacgttgggcgctaggtgtggggctcttccacgggttccgcgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacatcgccggaaaactcgtagagatacggggtccttttgggccggtgacaggtggtgcatggctgtcgtcagctcgtgtcgtgagatgttgggttaagtcccgcaacgagcgcaaccctcgttccatgttgccagcacgtgatggtggggactcatgggagaccgccggggtcaactcggaggaaggtggggatgacgtcaagtcatcatgccccttatgtcttgggctgcaaacatgctacaatggccggtacagagggctgcgataccgtgaggtggagcgaatccctaaaagccggtctcagttcggatcgaagtctgcaactcgacttcgtgaagtcggagtcgctagtaatcgcagatcagcaacgctgcggtgaatacgttcccgggccttgtacacaccgcccgtcacgtcacgaaagtcggcaacacccgaagcccgtggcccaaccacttgtggggggagcggtcgaaggtggggccggcgattgggacgaagtcgtaacaaggtagccgtaccggaaggtgcggctggatcacctcctttctaaggag

SEQ ID NO: 1098 - DNA, 1549 bp, Actinomycetaceae bacterium Marseille-P6182
  ref <308>: DATABASE ACCESSION NUMBER: NCBI ACCESSION: NZ_UWPE01000002.1
  ref <309>: DATABASE ENTRY DATE: 2019-04-01
  ref <313>: RELEVANT RESIDUES IN SEQ ID NO: (1)..(1549)
ttttgtggagagtttgattctggctcaggacgaacgctggcggcgtgcttaacacatgcaagtcgaacggtaaggcgcctcaacttgttggggtgtacacgagtggcgaacgggtgagtaatacgtgagtaacctgcccttccttttgggataagccttggaaacggggtctaatactggatattctgcgtcccacgcatgtggggtgttggaaagggtttttctgaggggggatgggctcgcggcctatcagcttgttggtggggtgatggcctaccaaggcggtgacgggtagccggcctgagagggtgaccggccacattgggactgagatacggcccaggctcctacgggaggcagcagtgggggatattgcacaatgggcggaagcctgatgcagcgacgccgcgtgggggatgacggctttcgggttgtaaacctctttcgctggggaacaaggccttgagtgttcttggggttgagggtacctggataagaagcgccggctaactacgtgccagcagccgcggtaatacgtagggcgcgagcgttgtccggaattattgggcgtaaagagcttgtaggcggcttgttgcgcctgctgtgaaaacttggggcttaaccctgagcgtgcagtgggtacgggcaggctagagtgtggtaggggtgattggaactccaggtgtagcggtggaatgcgcagatatctggaagaacaccgatggcgaaggcaggtcactgggccattactgacgctgagaagcgaaagcgtggggagcgaacaggattagataccctggtagtccatgctgtaaacgttgggaactaggtgtggggtccttccacggggtctgcgccgtagctaacgcattaagttccccgcctggggagtacggccgcaaggctaaaactcaaagaaattgacgggggcccgcacaagcggcggagcatgcggattaattcgatgcaacgcgaagaaccttaccaaggcttgacatctacttggacatgccagagatggtgtggcccttttagggcgggtagacaggtggtgcatggttgtcgtcagctcgtgtcgtgagatgttgggttaagtcccgcaacgagcgcaacccttgtctcgtgttaccagcggtttggccggggactcacgagagactgccggggttaactcggaggagggtggggatgacgtcaaatcatcatgccccttatgtcttgggcttcacgcatgctacaatggccggtacagagggtggcgatactgtgaggtggagcgaatcccttaaagctggtctcagttcggattggggtctgcaactcgaccccatgaagtcggagtcgctagtaatcgcagatcagcaacgctgcggtgaatacgttctcgggccttgtacacaccgcccgtcacgtcatgaaagtcggcaacacccgaagctcgtggcctaacccttgtggggggagcggtcgaaggtggggctggtgattgggacgaagtcgtaacaaggtagccgtaccggaaggtgcggctggatcacctcctttctaa

SEQ ID NO: 1099 - DNA, 1541 bp, Actinomycetospora cinnamomea
  ref <308>: DATABASE ACCESSION NUMBER: NCBI ACCESSION: NZ_QEKW01000038.1
  ref <309>: DATABASE ENTRY DATE: 2019-04-01
  ref <313>: RELEVANT RESIDUES IN SEQ ID NO: (1)..(1541)
tttgttggagagtttgatcctggctcaggacgaacgctggcggcgtgcttaacacatgcaagtcgagcggtaaggcccttcggggtacacgagcggcgaacgggtgagtaacacgtgggtgacctgccctccacttcgggataagcctgggaaactgggtctaataccggataggacctccggatgcatgtctggtggtggaaagttttgtcggtgggggatgggcccgcggtctatcagcttgttggtggggtgatggcctaccaaggcgacgacggatagccggcctgagagggtgatcggccacactgggactgagacacggcccagactcctacgggaggcagcagtggggaatcttgcgcaatgggcggaagcctgacgcagcaacgccgcgtgggggatgacggccttcgggttgtaaacctctttcgcgatcgacgaagctcgtacttctggtacgggtgacggtaggtcgagaagaagcaccggccaactacgtgccagcagccgcggtaatacgtagggtgcgagcgttgtccggaattattgggcgtaaagagctcgtaggcggtgtgtcgcgtcggccgtgaaaacctggggcttaactctgggcgtgcggtcgatacgggcatcactggagttcggcaggggagactggaattcctggtgtagcggtgaaatgcgcagatatcaggaggaacaccggtggcgaaggcgggtctctgggccgatactgacgctgaggagcgaaagcatgggtagcgaacaggattagataccctggtagtccatgccgtaaacgttgggcgctaggtgtggggtccattccacgggttccgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgcaccggacgcgtccagagatgggcgttcccttgtggctggtgtgcaggtggtgcatggctgtcgtcagctcgtgtcgtgagatgttgggttaagtcccgcaacgagcgcaacccttgtcctatgttgccagcacgtgatggtggggactcatgggagactgccggggtcaactcggaggaaggtggggatgacgtcaagtcatcatgccccttatgtccagggcttcacacatgctacaatggccggtacagagggctgcgaagccgtgaggtggagcgaatctcgtaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccgtggcccaacccgcaagggggggagcggtcgaaggtgggactggcgattgggacgaagtcgtaacaaggtagccgtaccggaaggtgcggctggatcacctcctttctaaggag

SEQ ID NO: 1100 - DNA, 1527 bp, Actinoplanes sp. ATCC 53533
  ref <308>: DATABASE ACCESSION NUMBER: NCBI ACCESSION: NZ_QHHV01000131.1
  ref <309>: DATABASE ENTRY DATE: 2019-04-01
  ref <313>: RELEVANT RESIDUES IN SEQ ID NO: (1)..(1527)
tgttggagagtttgatcctggctcaggacgaacgctggcggcgtgcttaacacatgcaagtcgagcggaaaggcccttcggggtactcgagcggcgaacgggtgagtaacacgtgaggaacctgccctggactttgggataaccctcggaaacgggggctaataccgaatacgacacggtctcgcatgagatccgtgtggaaagtttttcggtctgggatggtctcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgcggctcaaccgcgggcctgcagccgatacgggcaggctagagttcggtaggggagactggaattcctggtgtagcggtgaaatgcgcagatatcaggaggaacaccgatggcgaaggcaggtctctgggccgatactgacgctgaggagcgaaagcgtggggagcgaacaggattagataccctggtagtccacgctgtaaacgttgggcgctaggtgtgggggacctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcgccggaaaactcgtagagatacggggtccttcggggccggtgacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaaagggctgcgatgccgtaaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagcccatggcctaaccccgcaaggggagggagtggtcgaaggtggggctggcgattgggacgaagtcgtaacaaggtagccgtaccggaaggtgcggctggatcacctcctttctaaggagc

SEQ ID NO: 1101 - DNA, 1527 bp, Actinoplanes sp. LAM7112
  ref <308>: DATABASE ACCESSION NUMBER: NCBI ACCESSION: NZ_RJAC01000064.1
  ref <309>: DATABASE ENTRY DATE: 2019-04-01
  ref <313>: RELEVANT RESIDUES IN SEQ ID NO: (1)..(1527)
tgttggagagtttgatcctggctcaggacgaacgctggcggcgtgcttaacacatgcaagtcgagcggaaaggcccttcggggtactcgagcggcgaacgggtgagtaacacgtgagtaacctgccccaaactttgggataaccctcggaaacgggggctaataccggatatgactttcggctgcatggctgagggtggaaagtttttcggtttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcgccggccaactacgtgccagcagccgcggtaagacgtagggcgcgagcgttgtccggatttattgggcgtaaagagctcgtaggcggcttgtcgcgtcgaccgtgaaaacttggggctcaaccccaagcctgcggtcgatacgggcaggctcgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggggacctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactgtcagagatggcaggtccttcgggggcggtcacaggtggtgcatggctgtcgtcagctcgtgtcgtgagatgttgggttaagtcccgcaacgagcgcaaccctcgttccatgttgccagcgcgttatggcggggactcatggaagactgccggggtcaactcggaggaaggtggggatgacgtcaagtcatcatgccccttatgtccagggcttcacgcatgctacaatggccggtacaaaccgttgcgagcccgtgagggggagcgaatcggaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcctaaccccgtaaggggagggagccgtcgaaggtggggctggcgattgggacgaagtcgtaacaaggtagccgtaccggaaggtgcggctggatcacctcctttctaaggagca

SEQ ID NO: 1102 - DNA, 1524 bp, Actinoplanes sp. OR16
  ref <308>: DATABASE ACCESSION NUMBER: NCBI ACCESSION: NZ_AP019371.1
  ref <309>: DATABASE ENTRY DATE: 2019-04-01
  ref <313>: RELEVANT RESIDUES IN SEQ ID NO: (1)..(1524)
tgttggagagtttgatcctggctcaggacgaacgctggcggcgtgcttaacacatgcaagtcgagcggaaaggcccttcggggtactcgagcggcgaacgggtgagtaacacgtgagtaacctgccccgaactttgggataaccctcggaaacgggggctaataccgaatatgacttcctgccgcatggcatggttgtggaaagtttttcggttcgggatggactcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcgccggccaactacgtgccagcagccgcggtaagacgtagggcgcgagcgttgtccggatttattgggcgtaaagagctcgtaggcggcttgtcgcgtcgaatgtgaaatctcggggctcaactccgagcttgcattcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggaccctctccgggtttctgcgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatggccgcaaaactgtcagagatggcaggtccttcgggggcggtcacaggtggtgcatggctgtcgtcagctcgtgtcgtgagatgttgggttaagtcccgcaacgagcgcaaccctcgtccgatgttgccagcatttagttggggactcatcggagactgccggggtcaactcggaggaaggtggggatgacgtcaagtcatcatgccccttatgtccagggcttcacgcatgctacaatggccggtacaaagggctgcgataccgtaaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcctaacccgtaagggagggagccgtcgaaggtggggctggcgattgggacgaagtcgtaacaaggtagccgtaccggaaggtgcggctggatcacctcctttctaaggagca

SEQ ID NO: 1103 - DNA, 1526 bp, Actinoplanes teichomyceticus
  ref <308>: DATABASE ACCESSION NUMBER: NCBI ACCESSION: NZ_CP023865.1
  ref <309>: DATABASE ENTRY DATE: 2019-04-01
  ref <313>: RELEVANT RESIDUES IN SEQ ID NO: (1)..(1526)
tgttggagagtttgatcctggctcaggacgaacgctggcggcgtgcttaacacatgcaagtcgagcggaaaggcccttcggggtactcgagcggcgaacgggtgagtaacacgtgagtaacctgccccagactttgggataaccctcggaaacgggggctaataccggatatgaccttcggccgcatggttgttggtggaaagtttttcggtttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcgccggccaactacgtgccagcagccgcggtaagacgtagggcgcgagcgttgtccggatttattgggcgtaaagagctcgtaggcggcttgtcgcgtcgtctgtgaaaacttggggctcaaccccaagcttgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggggacctctccggtcttctgcgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcaccgcaaatcttccagagatgggaggtccttcgggggcggtgacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaaagggctgcgaaatcgtaaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcctaaccccttgtgggagggagccgtcgaaggtggggctggcgattgggacgaagtcgtaacaaggtagccgtaccggaaggtgcggctggatcacctcctttctaaggagca

SEQ ID NO: 1104 - DNA, 1525 bp, Actinosynnema pretiosum
  ref <308>: DATABASE ACCESSION NUMBER: NCBI ACCESSION: NZ_CP029607.1
  ref <309>: DATABASE ENTRY DATE: 2019-04-01
  ref <313>: RELEVANT RESIDUES IN SEQ ID NO: (1)..(1525)
ttattggagagtttgatcctggctcaggacgaacgctggcggcgtgcttaacacatgcaagtcgagcggtaaggcccttcggggtacacgagcggcgaacgggtgagtaacacgtgggtaacctgccctgtactctgggataagcctgggaaactaggtctaataccggatacgagccttccccgcatggggttggttggaaagttccggcggtacaggatggacccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggacgacggccttcgggttgtaaacctctttcagcagggacgaagcgcaagtgacggtacctgcagaagaagcaccggctaactacgtgccagcagccgcggtaatacgtagggtgcgagcgttgtccggaattattgggcgtaaagagctcgtaggcggtttgtcgcgtcggccgtgaaaacttggggcttaaccccgagcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacggtgggtgctaggtgtgggggacttccacgtcctccgtgccgcagctaacgcattaagcaccccgcctggggagtacggccgcaaggctaaaactcaaaggaattgacgggggcccgcacaagcggcggagcatgtggattaattcgatgcaacgcgaagaaccttacctgggcttgacatgcactggaaaccagtagagatattggcccccttgtggccggtgtacaggtggtgcatggctgtcgtcagctcgtgtcgtgagatgttgggttaagtcccgcaacgagcgcaaccctcgttccatgttgccagcgcgttatggcggggactcatgggagactgccggggtcaactcggaggaaggtggggatgacgtcaagtcatcatgccccttatgtccagggcttcacacatgctacaatggccggtacaaagggctgctaagccgtgaggtggagcgaatcccataaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccgtggcccaacccgcaagggggggagcggtcgaaggtgggactggcgattgggacgaagtcgtaacaaggtagccgtaccggaaggtgcggctggatcacctcctttctaaggag

SEQ ID NO: 1105 - DNA, 1549 bp, Actinotignum sanguinis
  ref <308>: DATABASE ACCESSION NUMBER: NCBI ACCESSION: NZ_QDIE01000051.1
  ref <309>: DATABASE ENTRY DATE: 2019-04-01
  ref <313>: RELEVANT RESIDUES IN SEQ ID NO: (1)..(1549)
tttgtggagagtttgatcctggctcaggacgaacgctggcggcgtgcttaacacatgcaagtcgaacgatgaagcttacaacttgttgtgggtggattagtggcgaacgggtgagtaatacgtgagtaacctgccctcctttttgggataagccttggaaacggggtctaataccggatattctggcatgctcgcatgggtgtgttgggaaagctttatgtgaagggggatgggctcgcggcctatcagcttgttggtggggtgatggcctaccaaggcggtgacgggtagccggcctgagagggtgaccggccacattgggactgagatacggcccagactcctacgggaggcagcagtgggggatattgcacaatgggcgaaagcctgatgcagcgacgccgcgtgggggatgaaggctttcgggttgtaaacctctttcgctatcgaacaaggctcattttttggtgggttgagggtaggtggagaagaagcgccggctaactacgtgccagcagccgcggtaatacgtagggcgcgagcgttgtccggaattattgggcgtaaagggcttgtaggcggcttgttgcgcctgctgtgaaaacgcggggcttaacttcgcgcgtgcagtgggtacgggcaggcttgagtgtggtaggggtgactggaattccaggtgtagcggtggaatgcgcagatatctggaggaacaccgatggcgaaggcaggtcactgggccattactgacgctgaggagcgaaagcatgggtagcgaacaggattagataccctggtagtccatgctgtaaacgttgggaactaggtgtggggggcctttccaggttttctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacaccgcggggctgcagagatgtggttgcatttagttggtggtgtacaggtggtgcatggttgtcgtcagctcgtgtcgtgagatgttgggttaagtcccgcaacgagcgcaacccttgtctcgtgttgccagcatgttgtggtggggactcacgagagactgccggggttaactcggaggaaggtggggatgacgtcaaatcatcatgccccttatgtcttgggcttcacgcatgctacaatggccggtacagagggttgcgatatcgtgaggtggagcgaatcccttaaagctggtctcagttcggatcggggtctgcaactcgacctcgtgaagtcggagtcgctagtaatcgcggatcagcattgccgcggtgaatacgttcccgggccttgtacacaccgcccgtcacgtcacgaaagttggtaacacccgtagctcgtggcctaaccatttttggggggagcggtcgaaggtggggctggcgattgggacgaagtcgtaacaaggtagccgtaccggaaggtgcggctggatcacctcctttctaagga

SEQ ID NO: 1106 - DNA, 1464 bp, Acuticoccus kandeliae
  ref <308>: DATABASE ACCESSION NUMBER: NCBI ACCESSION: NZ_QBBV01000008.1
  ref <309>: DATABASE ENTRY DATE: 2019-04-01
  ref <313>: RELEVANT RESIDUES IN SEQ ID NO: (1)..(1464)
caacttgagagtttgatcctggctcagaacgaacgctggcggcaggcttaacacatgcaagtcgaacgcaccttcgggtgagtggcagacgggtgagtaacgcgtgggaatctacctatcggttcgggataacctccggaaacggaagctaataccggatacgccccttgggggaaagatttattgccgatagatgagcccgcgttggattagctagttggtgaggtaacggctcaccaaggcgacgatccatagctggtctaagaggatgatcagccacactgggactgagacacggcccagactcctacgggaggcagcagtggggaatattggacaatgggcgaaagcctgatccagccatgccgcgtgagtgatgaaggccttagggttgtaaagctctttcgctagggaagataatgacggtacctagtaaagaagccccggctaacttcgtgccagcagccgcggtaatacgaagggggctagcgttgttcggaattactgggcgtaaagcgcgcgtaggcggctcattaagtcaggggtgaaatcccggggctcaacctcggaattgcctttgatactggtgagcttgagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatgatagctagccgtcgggatgcatgcatctcggtggcgcagttaacgcattaagctatccgcctggggagtacggtcgcaagattaaaactcaaaggaattgacgggggcctgcacaagcggtggagcatgtggtttaattcgaagcaacgcgcagaaccttaccagctcttgacatgccgtgttaccagcggagacgttgggttcccttcggggacgcggacacaggtgctgcatggctgtcgtcagctcgtgtcgtgagatgttgggttaagtcccgcaacgagcgcaaccctcgcctttagttgccagcattcagttgggcactctaaagggactgccggtgataagccgagaggaaggtggggatgacgtcaagtcctcatggcccttacgggctgggctacacacgtgctacaatggcagtgacaatgggtgaatcccaaaaagctgtctcagttcggattgtcctctgcaactcgagggcatgaagtcggaatcgctagtaatcgtggaacagcatgccacggtgaatacgttcccaggccttgtacacaccgcccgtcacaccatgggagttggttctacccgaagacgctgtgctaaccgcaaggaggcaggcggccacggtagggtcagcgactggggtgaagtcgtaacaaggtagccgtaggggaacctgcggctggatcacctcctttctaa

SEQ ID NO: 1107 - DNA, 1466 bp, Acuticoccus sp. PTG4-2
  ref <308>: DATABASE ACCESSION NUMBER: NCBI ACCESSION: NZ_QHHQ01000029.1
  ref <309>: DATABASE ENTRY DATE: 2019-04-01
  ref <313>: RELEVANT RESIDUES IN SEQ ID NO: (1)..(1466)
caacttgagagtttgatcctggctcagaacgaacgctggcggcaggcttaacacatgcaagtcgaacgcacccttcggggtgagtggcagacgggtgagtaacgcgtgggaacctacctttcggttcggaataacttggggaaactcaagctaataccggatacgcccttcgggggaaagatttattgccgatggatgggcccgcgttggattagctagttggtgtggtaatggcgcaccaaggcgacgatccatagctggtctaagaggatgatcagccacactgggactgagacacggcccagactcctacgggaggcagcagtggggaatattggacaatgggcgaaagcctgatccagccatgccgcgtgagtgatgacggccttagggttgtaaagctctttcgccagggatgataatgacagtacctggtaaagaagccccggctaacttcgtgccagcagccgcggtaatacgaagggggctagcgttgttcggaattactgggcgtaaagcgcgcgtaggcggatcattaagtcaggggtgaaatcccggggctcaacctcggaattgcctctgatactggtggtcttgagtccgtgagaggtaagtggaactccgagtgtagaggtgaaattcgtagatattcggaagaacaccagtggcgaaggcggcttactggcacggtactgacgctgaggtgcgaaagcgtggggagcaaacaggattagataccctggtagtccacgccgtaaacgatgatagctagccgtcggggtgcatgcatctcggtggcgcagttaacgcattaagctatccgcctggggagtacggtcgcaagattaaaactcaaaggaattgacgggggcctgcacaagcggtggagcatgtggtttaattcgaagcaacgcgcagaaccttaccagctcttgacatcccctgcgacttgcggagacgcaaggttcccttcggggacagggtgacaggtgctgcatggctgtcgtcagctcgtgtcgtgagatgttgggttaagtcccgcaacgagcgcaaccctcgcctttagttgccagcattcagttgggcactctaaagggactgccggtgataagccgagaggaaggtggggatgacgtcaagtcctcatggcccttacgggctgggctacacacgtgctacaatggcagtgacaatgggtgaatccctaaaagctgtctcagttcggattgtcctctgcaactcgagggcatgaagttggaatcgctagtaatcgtggaacagcatgccacggtgaatacgttcccaggccttgtacacaccgcccgtcacaccatgggagttggttctacccgaagacgctgtgctaaccgcaagggggcaggcggccacggtagggtcagcgactggggtgaagtcgtaacaaggtagccgtaggggaacctgcggctggatcacctcctttctaa

SEQ ID NO: 1108 - DNA, 1467 bp, Acuticoccus yangtzensis
  ref <308>: DATABASE ACCESSION NUMBER: NCBI ACCESSION: NZ_QBBW01000020.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcttaacacatgcaagtcgaacgcactcttcggagtgagtggcagacgggtgagtaacgcgtgggaacctacctatcggttcggaataacgttcggaaacggacgctaataccggataagcccttcgggggaaagatttattgccgattgatgggcccgcgttggattagctagttggtgtggtaatggcgcaccaaggcgacgatccatagctggtctaagaggatgatcagccacactgggactgagacacggcccagactcctacgggaggcagcagtggggaatattggacaatgggcgaaagcctgatccagccatgccgcgtgagtgatgacggccttagggttgtaaagctctttcgctagggatgataatgacagtacctagtaaagaagccccggctaacttcgtgccagcagccgcggtaatacgaagggggctagcgttgttcggaattactgggcgtaaagcgcgcgtaggcggatcattaagtcaggggtgaaatcccggggctcaacctcggaattgcctctgatactggtggtcttgagtccgtgagaggtgagtggaactccgagtgtagaggtgaaattcgtagatattcggaagaacaccagtggcgaaggcggctcactggcacggtactgacgctgaggtgcgaaagcgtggggagcaaacaggattagataccctggtagtccacgccgtaaacgatgatagctagccgtcggggtgcatgcacctcggtggcgcagttaacgcattaagctatccgcctggggagtacggtcgcaagattaaaactcaaaggaattgacgggggcctgcacaagcggtggagcatgtggtttaattcgaagcaacgcgcagaaccttaccagctcttgacatcccctgctcgctggagagatccagttttcccttcggggacagggtgacaggtgctgcatggctgtcgtcagctcgtgtcgtgagatgttgggttaagtcccgcaacgagcgcaaccctcgcctctagttgccagcatttggttgggcactctagagggactgccggtgataagccgagaggaaggtggggatgacgtcaagtcctcatggcccttacgggctgggctacacacgtgctacaatggcagtgacaatgggtaaatcccaaaaagctgtctcagttcggattgttctctgcaactcgagagcatgaagttggaatcgctagtaatcgtggaacagcatgccacggtgaatacgttcccaggccttgtacacaccgcccgtcacaccatgggagttggttctacccgaagatgctgtgctaaccgcaagggggcaggcagccacggtagggtcagcgactggggtgaagtcgtaacaaggtagccgtaggggaacctgcggctggatcacctcctttctaa

SEQ ID NO: 1109 - DNA, 1524 bp, Adhaeribacter aquaticus
  ref <308>: DATABASE ACCESSION NUMBER: NCBI ACCESSION: NZ_KI421517.1
  ref <309>: DATABASE ENTRY DATE: 2019-04-01
  ref <313>: RELEVANT RESIDUES IN SEQ ID NO: (1)..(1524)
tacaatggagagtttgatcctggctcaggatgaacgctagcggcaggcctaatacatgcaagtcgaacgggtctaggtagcaatacctagattagtggcgcacgggtgcgtaacgcgtatgcaacctaccttctattgggggatagccttccgaaaggaagattaataccgcataatatcatttgatggcatctgaagatgattaaagctacggcgatagaagatgggcatgcgtgacattagctagttggttgaggtaacggctcaccaaggctacgatgtctaggggttctgagaggatgatcccccacactggtactgagatacggaccagactcctacgggaggcagcagtagggaatattgggcaatggacgcaagtctgacccagccatgccgcgtgcaggatgaaggccttctgggttgtaaactgcttttatctaggaagaaaatactcttgcgagaggaactgacggtactagatgaataagcaccggctaactccgtgccagcagccgcggtaatacggagggtgcaagcgttgtccggatttattgggtttaaagggtgcgtaggcggccttgtaagtcagtggtgaaagcccatcgctcaacgatggaactgccattgatactgcaaggcttgagtacagacgaggtaggcggaattgatagtgtagcggtgaaatgcatagatactatcaagaacaccgattgcgtaggcagcttactaggctgtaactgacgctgaggcacgaaagcgtggggagcgaacaggattagataccctggtagtccacgctgtaaacgatgattactcgatgttggcgataaactgtcagcgtcttagcgaaagcgttaagtaatccacctggggagtacgcccgcaagggtgaaactcaaaggaattgacgggggcccgcacaagcggtggagcatgtggtttaattcgatgatacgcgaggaaccttacctaggctagaatgcgcgtgaccgatccagagatggatctttccttcgggacacaaagcaaggtgctgcatggctgtcgtcagctcgtgccgtgaggtgttgggttaagtcccgcaacgagcgcaacccctatctttagttgccagcacattatggtggggactctaaagagactgcctgcgcaagcagtgaggaaggtggggatgacgtcaagtcatcatggcccttacgcctagggctacacacgtgctacaatggacggtacaaagggtcgctacttggtaacaagatgccaatctcaaaaaaccgttctcagttcggattgaggtctgcaactcgacctcatgaagctggaatcgctagtaatcgcgtatcagcaatgacgcggtgaatacgttcccgggccttgtacacaccgcccgtcaagccatggaagtcagggagacctgaagatcgtaacccacaaggagcgatttagggtaaaactggtaactggggctaagtcgtaacaaggtagccgtaccggaaggtgcggctggatcacctcctttct

SEQ ID NO: 1110 - DNA, 1527 bp, Adhaeribacter sp. HMF7605
  ref <308>: DATABASE ACCESSION NUMBER: NCBI ACCESSION: NZ_PYFT01000001.1
  ref <309>: DATABASE ENTRY DATE: 2019-04-01
  ref <313>: RELEVANT RESIDUES IN SEQ ID NO: (1)..(1527)
tggagagtttgatcctggctcaggatgaacgctagcggcaggcctaatacatgcaagtcgaacgggtctaggtagcaatacctagattagtggcgcacgggtgcgtaacgcgtatgcaacctaccttttattgggggatagcccgaagaaattcggattaataccgcataacactgtttgagggcatctgaagacagttaaagctacggcgataaaagatgggcatgcgtgtcattagctagttggtgaggtaacggctcaccaaggcaacgatgactaggggttctgagaggatgatcccccacactggtactgagatacggaccagactcctacgggaggcagcagtagggaatattgggcaatggccgcaaggctgacccagccatgccgcgtgccggatgaaggccttctgggttgtaaacggcttttaccagggaagaaaatacctttgcgaagggaactgacggtacctggtgaataagcaccggctaactccgtgccagcagccgcggtaatacggagggtgcaagcgttgtccggatttattgggtttaaagggtgcgtaggcggccaagtaagtccgtggtgaaagccaacagctcaactgttgaactgccatggatactgctaggcttgagtacagacgaggtaggcggaatggatagtgtagcggtgaaatgcatagatactatccagaacaccgattgcgaaggcagcttactagactgtaactgacgctgaggcacgaaagcgtggggagcgaacaggattagataccctggtagtccacgccgtaaacgatgataactcgatgttggcgatacacggccagcgtcttagcgaaagcgttaagttatccacctggggagtacgcccgcaagggtgaaactcaaaggaattgacgggggcccgcacaagcggtggagcatgtggtttaattcgatgatacgcgaggaaccttacctaggctagaatgcgcgtgactgcttcagagatgaggcttcccttcggggcacaaagcaaggtgctgcatggctgtcgtcagctcgtgccgtgaggtgttgggttaagtcccgcaacgagcgcaacccctatctttagttgccagcacatcatggtggggactctagagagactgcctgcgcaagcagtgaggaaggtggggacgacgtcaagtcatcatggcccttacgcctagggctacacacgtgctacaatgggcggtacagagggtcgctacttagtaataagatgccaatctcaaaaaaccgttctcagttcggattgaggtctgcaactcgacctcatgaagctggaatcgctagtaatcgcgtatcagcaatgacgcggtgaatacgttcccgggccttgtacacaccgcccgtcaagccatggaagtcagggagacctgaagacggtaaccaatgaggagccgtttagggtaaaactggtaactggggctaagtcgtaacaaggtagccgtaccggaaggtgcggctggatcacctcctttctggagctgat

SEQ ID NO: 1111 - DNA, 1519 bp, Adhaeribacter sp. HMF7616
  ref <308>: DATABASE ACCESSION NUMBER: NCBI ACCESSION: NZ_QASA01000001.1
  ref <309>: DATABASE ENTRY DATE: 2019-04-01
  ref <313>: RELEVANT RESIDUES IN SEQ ID NO: (1)..(1519)
tggagagtttgatcctggctcaggatgaacgctagcggcaggcctaatacatgcaagtcgaacgggctggggtagcaatactccagttagtggcgcacgggtgcgtaacgcgtatgcaacctaccttttattgggggatagcccgaagaaattcggattaataccgcataatactgtttgagggcatctgaagacagttaaagctgaggcgataaaagatgggcatgcgtgtcattagctagttggtagaggtaacggctcaccaaggcgacgatgactaggggttctgagaggatgatcccccacactggtactgagatacggaccagactcctacgggaggcagcagtagggaatattgggcaatggccgaaaggctgacccagccatgccgcgtgccggatgaaggccttctgggttgtaaacggcttttaccagggaagaaaatacctttgcgaagggaactgacggtacctggtgaataagcaccggctaactccgtgccagcagccgcggtaatacggagggtgcaagcgttgtccggatttattgggtttaaagggtgcgtaggcggcgtaataagtccgtggtgaaagccaacagctcaactgttgaactgccatggatactgttaggcttgagtacagacgaggtaggcggaatggatcgtgtagcggtgaaatgcatagatacgatccagaactccgattgcgaaggcagcttactaggctgtaactgacgctgaggcacgaaagcgtggggagcgaacaggattagataccctggtagtccacgctgtaaacgatgataactcgatgttggcgatacacggtcagcgtcttagcgaaagcgttaagttatccacctggggagtacgcccgcaagggtgaaactcaaaggaattgacgggggcccgcacaagcggtggagcatgtggtttaattcgatgatacgcgaggaaccttacctaggctagaatgcgcgtgaccgcctcagagatgaggcttcccttcggggcacaaagcaaggtgctgcatggctgtcgtcagctcgtgccgtgaggtgttgggttaagtcccgcaacgagcgcaacccctatctttagttgccagcacgtgatggtggggactctagagagactgcctgcgcaagcagtgaggaaggtggggacgacgtcaagtcatcatggcccttacgcctagggctacacacgtgctacaatgggcggtacagagggtcgctacttagtaataagatgccaatctcaaaaaaccgttctcagttcggattgaggtctgcaactcgacctcatgaagctggaatcgctagtaatcgcgtatcagcaatgacgcggtgaatacgttcccgggccttgtacacaccgcccgtcaagccatggaagtcagggagacctgaagacggtaaccgttaaggagccgtttagggtaaaactggtaactggggctaagtcgtaacaaggtagccgtaccggaaggtgcggctggatcacctcctttct

SEQ ID NO: 1112 - DNA, 1518 bp, Adlercreutzia equolifaciens
  ref <308>: DATABASE ACCESSION NUMBER: NCBI ACCESSION: NZ_QVOJ01000008.1
  ref <309>: DATABASE ENTRY DATE: 2019-04-01
  ref <313>: RELEVANT RESIDUES IN SEQ ID NO: (1)..(1518)
ttcgaacggagagtttgatcctggctcaggatgaacgctggcggcgtgcttaacacatgcaagtcgaacgattaagacggcttcggccgtgtatagagtggcgaacgggtgagtaacacgtgaccaacctgccccgcgctccgggacaaccgctggaaacggcggctaataccggatgctccggggaggccccatggcctccccgggaaagccccgacggcgcgggatggggtcgcggcccattaggtagacggcggggtaacggcccaccgtgcccgcgatgggtagccggactgagaggtcgaccggccacattgggactgagatacggcccagactcctacgggaggcagcagtggggaattttgcgcaatgggggcaaccctgacgcagcaacgccgcgtgcgggacgaaggccttcgggttgtaaaccgctttcagcagggaagacatagacggtacctgcagaagaagctccggctaactacgtgccagcagccgcggtaatacgtagggggcgagcgttatccggattcattgggcgtaaagcgcgcgtaggcggccgcctaagcggaacctctaatcccggggctcaacctcgggccgggttccggactgggcggctcgagtgcggtagaggcaggcggaattcccggtgtagcggtggaatgcgcagatatcgggaagaacaccgatggcgaaggcagcctgctgggccgccactgacgctgaggcgcgaaagctgggggagcgaacaggattagataccctggtagtcccagccgtaaacgatggacgctaggtgtggggggaccatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcgagtgaagccgcggagacgcggtggccgagaggagctcgcgcaggtggtgcatggctgtcgtcagctcgtgtcgtgagatgttgggttaagtcccgcaacgagcgcaacccccgtcccgtgttgccagcattcagttggggactcgcgggagactgccggcgtcaagccggaggaaggtggggacgacgtcaagtcatcatgccccttatgccctgggctgcacacgtgctacaatggccggtacagagggttgccaccccgcgagggggagcggatcccggaaagccggtcccagttcggatcgcaggctgcaacccgcctgcgtgaagtcggagttgctagtaatcgcggatcagcatgccgcggtgaatacgttcccgggccttgtacacaccgcccgtcacaccacccgagtcgtctgcacccgaagccgccggccgaacccttctggggcggaggcgtcgaaggtgtggagggtaaggggggtgaagtcgtaacaaggtagccgtaccggaaggtgcggctggatcacctcctttctagggag

SEQ ID NO: 1113 - DNA, 1522 bp, Adlercreutzia sp. Marseille-P7992
  ref <308>: DATABASE ACCESSION NUMBER: NCBI ACCESSION: NZ_UYYE01000004.1
  ref <309>: DATABASE ENTRY DATE: 2019-04-01
  ref <313>: RELEVANT RESIDUES IN SEQ ID NO: (1)..(1522)
ttcgaacggagagttcgatcctggctcaggatgaacgctggcggcgtgcctaacacatgcaagtcgaacggttaagacggctccggccgtgaatagagtggcgaacgggtgagtaacacgtgaccaacctgccctccgcaccgggacaaccgggggaaaccccggctaataccggacgatcccggggccccgcatgggggcccgggcgaagcctcggcggcgggggatggggtcgcggcccattaggtagacggcggggcaacggcccaccgtgccgacgatgggtagccgggttgagagaccgaccggccacattgggactgagatacggcccagactcctacgggaggcagcagtggggaatattgcgcaatgggggcaaccctgacgcagcaacgccgcgtgcgggacgacggccttcgggttgtaaaccgctttcagcagggaagatcgtgacggtacctgcagaagaagccccggctaactacgtgccagcagccgcggtaatacgtagggggcgagcgttatccggattcattgggcgtaaagcgcgcgcaggcggcccgccaagcggaacctctaaccccggggctcaacctcgggccgggttccggactggcgggctcgagtgcggtagaggcaggcggaattcccggtgtagcggtggaatgcgcagatatcgggaagaacaccgatggcgaaggcagcctgctgggccgttcactgacgctgaggcgcgaaagctgggggagcgaacaggattagataccctggtagtcccagccgtaaacgatgggcgctaggtgtggggggaaccgtccctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgctagtgaagcggcggaaacgccgtggccggaaggagctagcgcaggtggtgcatggctgtcgtcagctcgtgtcgtgagatgttgggttaagtcccgcaacgagcgcaacccctgccccgtgttgccagcattcagttggggactcgcgggggactgccggtgacaaaccggaggaaggcggggacgacgtcaagtcatcatgccccttatgccctgggccgcacacgtgctacaatggccggcacagcgggctgccacccagcgatggggagcgaatcccgtaaagccggccccagttcggatcggaggctgcaacccgcctccgtgaagccggagttgctagtaatcgcggatcagcacgccgcggtgaatgcgttcccgggccttgtacacaccgcccgtcacaccacccgagtcgtctgcacccgaagccgccggccgaacccctccggggggcggaggcgtcgaaggtgtggagggtgaggggggtgaagtcgtaacaaggtagccgtaccggaaggtgcggctggatcacctcctttctagggag

SEQ ID NO: 1114 - DNA, 1556 bp, Aeribacillus pallidus
  ref <308>: DATABASE ACCESSION NUMBER: NCBI ACCESSION: NZ_SFCD01000153.1
  ref <309>: DATABASE ENTRY DATE: 2019-04-01
  ref <313>: RELEVANT RESIDUES IN SEQ ID NO: (1)..(1556)
tttttggagagtttgatcctggctcaggacgaacgctggcggcgtgcctaatacatgcaagtcgagcggaccgaagggagcttgctcctttaggttagcggcggacgggtgagtaacacgtgggcaacctgccctgcagactgggataacttcgggaaaccggagctaataccggataacaccgaaaaccgcatggttttcggttgaaaggcggcttttagctgtcactgcaggatgggcccgcggcgcattagctagttggtgaggtaacggctcaccaaggcgacgatgcgtagccgacctgagagggtgaccggccacactgggactgagacacggcccagactcctacgggaggcagcagtagggaatcttccgcaatggacgaaagtctgacggagcaacgccgcgtgagcgaagaaggtcttcggatcgtaaagctctgttgtcagggaagaacaagtaccgttcgaacagggcggtaccttgacggtacctgacgaggaagccacggctaactacgtgccagcagccgcggtaatacgtaggtggcaagcgttgtccggaattattgggcgtaaagcgcgcgcaggcggttccttaagtctgatgtgaaatctcgcggctcaaccgcgagcggccattggaaactggggaacttgagtgcaggagaggggagcggaattccacgtgtagcggtgaaatgcgtagagatgtggaggaacaccagtggcgaaggcggctctctggcctgtaactgacgctgaggcgcgaaagcgtggggagcgaacaggattagataccctggtagtccacgccgtaaacgatgagtgctaagtgttagagggtatccaccctttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccctgacaaccctagagatagggcgttcccctttcggggacagggtgacaggtggtgcatggttgtcgtcagctcgtgtcgtgagatgttgggttaagtcccgcaacgagcgcaacccttgaccttagttgccagcattcagttgggcactctaaggtgactgccggctaaaagtcggaggaaggtggggatgacgtcaaatcatcatgccccttatgacctgggctacacacgtgctacaatgggtggtacaaagggcagcgaaaccgcgaggtggagcgaatcccaaaaaaccactctcagttcggattgcaggctgcaactcgcctgcatgaagccggaatcgctagtaatcgcggatcagcatgccgcggtgaatacgttcccgggtcttgtacacaccgcccgtcacaccacgagagtttgtaacacccgaagtcggtggggtaacccttacgggagccagccgccgaaggtgggacaaatgattggggtgaagtcgtaacaaggtagccgtatcggaaggtgcggctggatcacctcctttct

SEQ ID NO: 1115 - DNA, 1553 bp, Aerococcaceae bacterium ZY16052
  ref <308>: DATABASE ACCESSION NUMBER: NCBI ACCESSION: NZ_CP023434.1
  ref <309>: DATABASE ENTRY DATE: 2019-04-01
  ref <313>: RELEVANT RESIDUES IN SEQ ID NO: (1)..(1553)
atgagagtttgatcctggctcaggacgaacgctggcggcgtgcctaatacatgcaagtcgaacgaaccgacggagaacttgttctcctgacgtgagtggcggacgggtgagtaacacgtggggaacctaccctttagtgggggataacaaccggaaacggttgctaataccgcatagtcaatcgagtcacctgatttgattgggaaagatggttctgctatcgctagaggatggccccgcggtgcattagttagttggtggggtaatggcctaccaagacgatgatgcatagccgacctgagagggtaatcggccacactgggactgagacacggcccagactcctacgggaggcagcagtagggaatcttccgcaatggacgcaagtctgacggagcaacgccgcgtgtgtgaagaaggttttcggatcgtaaagcactgttgttagagaagaacacccatgagagtaactgttcatggattgacggtatctaaccagaaagccacggctaactacgtgccagcagccgcggtaatacgtaggtggcaagcgttgtccggatttattgggcgtaaagggagcgcaggcggtgacttaagtctgatgtgaaagcccacggctcaaccgtggaaggtcattggaaactgggtcacttgaatgcagaagaggaaagtggaattccatgtgtagcggtgaaatgcgtagatatatggaggaacaccagtggcgaaggcgactttctggtctgacattgacgctgaggctcgaaagcgtggggagcgaacaggattagataccctggtagtccacgccgtaaacgatgagtgctaagtgttggggggcttccacccttcagtgctggcgttaacgcaataagcactccgcctggggagtacggccgcaaggctgaaactcaaaggaattgacggggacccgcacaagcggtggagcatgtggtttaattcgaagcaacgcgaagaaccttaccaggacttgacatctcctgcatagcctagagataggtgaaacctcttcggaggcaggaagacaggtggtgcatggttgtcgtcagctcgtgtcgtgagatgttgggttaagtcccgcaacgagcgcaacccctatgactagttgccagcattaagttggggactctagtgagactgccggtgacaaaccggaggaaggtggggatgacgtcaaatcatcatgccccttatgtcctgggctacacacgtgctacaatggatggtacagcgagcagcgaccccgcgagggcaagcgaatctccaaaagccattctcagttcggattgttctctgcaactcgagagcatgaagccggaatcgctagtaatcgtggatcagcacgccacggtgaatacgttcccgggtcttgtacacaccgcccgtcacaccacgagagtttgtaacacccgaagccggtggcctaaccctatggagggagccgtcgaaggtgggacagatgattggggtgaagtcgtaacaaggtagccgtatcggaaggtgcggctggatcacctcctttctaagga

SEQ ID NO: 1116 - DNA, 1556 bp, Aerococcus christensenii
  ref <308>: DATABASE ACCESSION NUMBER: NCBI ACCESSION: NZ_PKGZ01000011.1
  ref <309>: DATABASE ENTRY DATE: 2019-04-01
  ref <313>: RELEVANT RESIDUES IN SEQ ID NO: (1)..(1556)
tttcatgagagtttgatcctggctcaggacgaacgctggcggcgtgcctaatacatgcaagtcgagcgaacagagaaagtgcttgcactttcaaagttagcggcggacgggtgagtaacacgtaaggaacctaccgataagcgggggacaacatccggaaacgggtgctaataccgcataggaagtttgttcgcatgaacaaacttagaaagatggctctgctatcacttatcgatggccttgcggtgcattaactagttggcgaggtaacggctcaccaaggtgatgatgcatagccgacctgagagggtaatcggccacattgggactgagacacggcccaaactcctacgggaggcagcagtagggaatcttccgcaatggacgcaagtctgacggagcaacgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggggcgcaggctgcttcttaagtctgatgtgaaagcccacggcttaaccgtggaagtgcattggaaactgggaagcttgagtacagaagaggaaagtggaactccatgtgtagcggtggaatgcgtagatatatggaagaacaccagtggcgaaagcgactttctggtctgtcactgacgctgaggcccgaaagcgtgggtagcaaacaggattagataccctggtagtccacgccgtaaacgatgagcgctaggtgttggagggtttccacccttcagtgccgcagctaacgcattaagcgctccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccctattgttagttgccagcattgagttgggcactctagcaagactgccggtgacaaaccggaggaaggcggggatgacgtcaaatcatcatgccccttatgacttgggctacacacgtgctacaatggatggtacaacgggcagcgagctcgcgagagtcagcgaatcccttaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacaagtgattggggtgaagtcgtaacaaggtagccgtaggagaacctgcggctggatcacctcctttctaagga

SEQ ID NO: 1117 - DNA, 1557 bp, Aerococcus sanguinicola
  ref <308>: DATABASE ACCESSION NUMBER: NCBI ACCESSION: NZ_PKGY01000003.1
  ref <309>: DATABASE ENTRY DATE: 2019-04-01
  ref <313>: RELEVANT RESIDUES IN SEQ ID NO: (1)..(1557)
tttcatgagagtttgatcctggctcaggacgaacgctggcggcatgcctaatacatgcaagtcgagcgaaccgacgaagtgcttgcacttctgacgttagcggcggacgggtgagtaacacgtaaggaacctacctatgagcgggggacaacatccggaaacgggtgctaataccgcatagtaatttgtcaggcatctgacaaattggaaagacggcttttgctgtcactcatagatggtcttgcggtgcattagctagttggtgggataaaagcttaccaaggccatgatgcatagccgacctgagagggtaatcggccacactgggactgagacacggcccagactcctacgggaggcagcagtagggaatcttccgcaatgggcgcaagcctgacggagcaatgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtgcagaagaggaaagtggaactccatgtgtagcggtggaatgcgtagatatatggaagaacaccagtggcgaaggcgactttctggtctgtaactgacactgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcatttagttgggcactctagcgagactgccggtgacaaaccggaggaaggcggggatgacgtcaaatcatcatgccccttatgacttgggctacacacgtgctacaatggatggtacaacgggttgcgaactcgcgagagtcagcgaatcccttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaagga

SEQ ID NO: 1118 - DNA, 1558 bp, Aerococcus sp. 1KP-2016
  ref <308>: DATABASE ACCESSION NUMBER: NCBI ACCESSION: NZ_NEEY01000095.1
  ref <309>: DATABASE ENTRY DATE: 2019-04-01
  ref <313>: RELEVANT RESIDUES IN SEQ ID NO: (1)..(1558)
tttcatgagagtttgatcctggctcaggacgaacgctggcggcatgcctaatacatgcaagtcgtgcgaattgacgaagtacttgtacttctgacgttagcggcgaacgggtgagtaacacgtaaggaatctacctataagcgggggataacattcggaaacggatgctaataccgcataatacatatttccgcatggaaatacgttgaaagacggctctgctgtcacttatagatgaccttgcggtgcattagttagttggtggggtaatggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcattcagttgggcactctaatgagactgccggtgacaaaccggaggaaggtggggatgacgtcaaatcagcatgccccttatgacttgggctacacacgtgctacaatggatggtacagcgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggaa

SEQ ID NO: 1119 - DNA, 1445 bp, Aerococcus sp. HMSC035B07
  ref <308>: DATABASE ACCESSION NUMBER: NCBI ACCESSION: NZ_KV826873.1
  ref <309>: DATABASE ENTRY DATE: 2019-04-01
  ref <313>: RELEVANT RESIDUES IN SEQ ID NO: (1)..(1445)
gagtaacacgtaaggaacctacctatgagcgggggacaacatccggaaacgggtgctaataccgcatagtaatttgtcaggcatctgacaaattggaaagacggcttttgctgtcactcatagatggtcttgcggtgcattagctagttggtgggataaaagcttaccaaggccatgatgcatagccgacctgagagggtaatcggccacactgggactgagacacggcccagactcctacgggaggcagcagtagggaatcttccgcaatgggcgcaagcctgacggagcaatgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtgcagaagaggaaagtggaactccatgtgtagcggtggaatgcgtagatatatggaagaacaccagtggcgaaggcgactttctggtctgtaactgacactgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcatttagttgggcactctagcgagactgccggtgacaaaccggaggaaggcggggatgacgtcaaatcatcatgccccttatgacttgggctacacacgtgctacaatggatggtacaacgggctgcgaactcgcgagagtcagcgaatcccttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaagga

SEQ ID NO: 1120 - DNA, 1557 bp, Aerococcus sp. HMSC061A03
  ref <308>: DATABASE ACCESSION NUMBER: NCBI ACCESSION: NZ_KV811525.1
  ref <309>: DATABASE ENTRY DATE: 2019-04-01
  ref <313>: RELEVANT RESIDUES IN SEQ ID NO: (1)..(1557)
tttcatgagagtttgatcctggctcaggacgaacgctggcggcatgcctaatacatgcaagtcgagcgaaccgacgaagtgcttgcacttctgacgttagcggcggacgggtgagtaacacgtaaggaacctacctatgagcgggggacaacatccggaaacgggtgctaataccgcatagtaatttgtcaggcatctgacaaattggaaagacggcttttgctgtcactcatagatggtcttgcggtgcattagctagttggtgggataaaagcttaccaaggccatgatgcatagccgacctgagagggtaatcggccacactgggactgagacacggcccagactcctacgggaggcagcagtagggaatcttccgcaatgggcgcaagcctgacggagcaatgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtgcagaagaggaaagtggaactccatgtgtagcggtggaatgcgtagatatatggaagaacaccagtggcgaaggcgactttctggtctgtaactgacactgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcattcagttgggcactctagcgagactgccggtgacaaaccggaggaaggcggggatgacgtcaaatcatcatgccccttatgacttgggctacacacgtgctacaatggatggtacaacgggctgcgaactcgcgagagtcagcgaatcccttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaagga

SEQ ID NO: 1121 - DNA, 1557 bp, Aerococcus sp. HMSC062A02
  ref <308>: DATABASE ACCESSION NUMBER: NCBI ACCESSION: NZ_KV797909.1
  ref <309>: DATABASE ENTRY DATE: 2019-04-01
  ref <313>: RELEVANT RESIDUES IN SEQ ID NO: (1)..(1557)
tttcatgagagtttgatcctggctcaggacgaacgctggcggcatgcctaatacatgcaagtcgagcgaaccgacgaagtgcttgcacttctgacgttagcggcggacgggtgagtaacacgtaaggaacctacctatgagcgggggacaacatccggaaacgggtgctaataccgcatagtaatttgtcaggcatctgacaaattggaaagacggcttttgctgtcactcatagatggtcttgcggtgcattagctagttggtgggataaaagcttaccaaggccatgatgcatagccgacctgagagggtaatcggccacactgggactgagacacggcccagactcctacgggaggcagcagtagggaatcttccgcaatgggcgcaagcctgacggagcaatgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtgcagaagaggaaagtggaactccatgtgtagcggtggaatgcgtagatatatggaagaacaccagtggcgaaggcgactttctggtctgtaactgacactgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcatttagttgggcactctagcgagactgccggtgacaaaccggaggaaggcggggatgacgtcaaatcatcatgccccttatgacttgggctacacacgtgctacaatggatggtacaacgggctgcgaactcgcgagagtcagcgaatcccttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaagga

SEQ ID NO: 1122 - DNA, 1555 bp, Aerococcus sp. HMSC062B07
  ref <308>: DATABASE ACCESSION NUMBER: NCBI ACCESSION: NZ_KV799301.1
  ref <309>: DATABASE ENTRY DATE: 2019-04-01
  ref <313>: RELEVANT RESIDUES IN SEQ ID NO: (1)..(1555)
tttcatgagagtttgatcctggctcaggacgaacgctggcggcgtgcctaatacatgcaagtcgagcgaaccgacgaagtgcttgcacttctgacgttagcggcggacgggtgagtaacacgtaaggaacctaccgataagcgggggacaacatccggaaacgggtgctaataccgcataggaaaggccaccacatggtgacctttggaaagacggctttgctgtcacttatcgatggccttgcggtgcattagctcgttggtggggtaacggcctaccaaggcaatgatgcatagccgacctgagagggtaatcggccacattgggactgagacacggcccaaactcctacgggaggcagcagtagggaatcttccgcaatgggcgcaagcctgacggagcaacgccgcgtgagtgaagaaggttttcggatcgtaaagctctgttgtaagagaagaacaaattggagagtaactgctccagtcttgacggtatcttaccagaaagccacggctaactacgtgccagcagccgcggtaatacgtaggtggcaagcgttgtccggatttattgggcgtaaagggggcgcaggcggtttcttaagtctgatgtgaaagcccacggcttaaccgtggaagtgcattggaaactggggaacttgagtacagaagaggaaagtggaactccatgtgtagcggtggaatgcgtagatatatggaagaacaccagtggcgaaggcgactttctggtctgtcactgacgctgaggcccgaaagcgtgggtagcaaacaggattagataccctggtagtccacgccgtaaacgatgagtgctaggtgttggagggtttccacccttcagtgccggagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcattcagttgggcactctagcgagactgccggtgacaaaccggaggaaggcggggatgacgtcaaatcatcatgccccttatgacttgggctacacacgtgctacaatggatggtacaacgagcagcgaccttgtgaaagcaagcgaatctcttaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacctgaagtcggtgaggtaacctttggagccagccgccgaaggtgggacagatgattggggtgaagtcgtaacaaggtagccgtaggtgaacctgcggctggatcacctcctttctaagga

SEQ ID NO: 1123 - DNA, 1463 bp, Aerococcus sp. HMSC06H08
  ref <308>: DATABASE ACCESSION NUMBER: NCBI ACCESSION: NZ_KV789036.1
  ref <309>: DATABASE ENTRY DATE: 2019-04-01
  ref <313>: RELEVANT RESIDUES IN SEQ ID NO: (1)..(1463)
cgttagcggcggacgggtgagtaacacgtaaggaacctacctatgagcgggggacaacatccggaaacgggtgctaataccgcatagtaatttgtcaggcatctgacaaattggaaagacggcttttgctgtcactcatagatggtcttgcggtgcattagctagttggtgggataaaagcttaccaaggccatgatgcatagccgacctgagagggtaatcggccacactgggactgagacacggcccagactcctacgggaggcagcagtagggaatcttccgcaatgggcgcaagcctgacggagcaatgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtgcagaagaggaaagtggaactccatgtgtagcggtggaatgcgtagatatatggaagaacaccagtggcgaaggcgactttctggtctgtaactgacactgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcattcagttgggcactctagcgagactgccggtgacaaaccggaggaaggcggggatgacgtcaaatcatcatgccccttatgacttgggctacacacgtgctacaatggatggtacaacgggctgcgaactcgcgagagtcagcgaatcccttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaagga

SEQ ID NO: 1124 - DNA, 1557 bp, Aerococcus sp. HMSC072A12; identical to SEQ ID NO: 1120
  ref <308>: DATABASE ACCESSION NUMBER: NCBI ACCESSION: NZ_KV807403.1
  ref <309>: DATABASE ENTRY DATE: 2019-04-01
  ref <313>: RELEVANT RESIDUES IN SEQ ID NO: (1)..(1557)

SEQ ID NO: 1125 - DNA, 1555 bp, Aerococcus sp. HMSC075D05
  ref <308>: DATABASE ACCESSION NUMBER: NCBI ACCESSION: NZ_KV803595.1
  ref <309>: DATABASE ENTRY DATE: 2019-04-01
  ref <313>: RELEVANT RESIDUES IN SEQ ID NO: (1)..(1555)
tttcatgagagtttgatcctggctcaggacgaacgctggcggcgtgcctaatacatgcaagtcgagcgaaccgacgaagtgcttgcacttctgacgttagcggcggacgggtgagtaacacgtaaggaacctaccgataagcgggggacaacatccggaaacgggtgctaataccgcataggaaaggtcaccacatggtggcctttggaaagacggctttgctgtcacttatcgatggccttgcggtgcattagctcgttggtggggtaacggcctaccaaggcaatgatgcatagccgacctgagagggtaatcggccacattgggactgagacacggcccaaactcctacgggaggcagcagtagggaatcttccgcaatgggcgcaagcctgacggagcaacgccgcgtgagtgaagaaggttttcggatcgtaaagctctgttgtaagagaagaacaaattggagagtaactgctccagtcttgacggtatcttaccagaaagccacggctaactacgtgccagcagccgcggtaatacgtaggtggcaagcgttgtccggatttattgggcgtaaagggggcgcaggcggtttcttaagtctgatgtgaaagcccacggcttaaccgtggaagtgcattggaaactggggaacttgagtacagaagaggaaagtggaactccatgtgtagcggtggaatgcgtagatatatggaagaacaccagtggcgaaggcgactttctggtctgtcactgacgctgaggcccgaaagcgtgggtagcaaacaggattagataccctggtagtccacgccgtaaacgatgagtgctaggtgttggagggtttccacccttcagtgccggagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcattcagttgggcactctagcgagactgccggtgacaaaccggaggaaggcggggatgacgtcaaatcatcatgccccttatgacttgggctacacacgtgctacaatggatggtacaacgagcagcgaccttgtgaaagcaagcgaatctcttaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacctgaagtcggtgaggtaacctttggagccagccgccgaaggtgggacagatgattggggtgaagtcgtaacaaggtagccgtaggtgaacctgcggctggatcacctcctttctaagga

SEQ ID NO: 1126 - DNA, 1558 bp, Aerococcus sp. HMSC10H05
  ref <308>: DATABASE ACCESSION NUMBER: NCBI ACCESSION: NZ_KV786979.1
  ref <309>: DATABASE ENTRY DATE: 2019-04-01
  ref <313>: RELEVANT RESIDUES IN SEQ ID NO: (1)..(1558)
tttcatgagagtttgatcctggctcaggacgaacgctggcggcatgcctaatacatgcaagtcgagcgaacagacgaagtgcttgcacttctgacgttagcggcgaacgggtgagtaacacgtaaggaatctacctataagcgggggataacattcggaaacgggtgctaataccgcataatatcttcttccgcatggaagaagattgaaagacggctctgctgtcacttatagatgaccttgcggtgcattagttagttggtggggtaacggcctaccaaggcgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaagcttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcatttagttgggcactctaatgagactgccggtgacaaaccggaggaaggtggggatgacgtcaaatcagcatgccccttatgacttgggctacacacgtgctacaatggatggtacaacgagtcgcaaactcgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagccgccgaaggtgggacagataattggggtgaagtcgtaacaaggtagccgtatcggaaggtgcggctggatcacctcctttctaaggaa

SEQ ID NO: 1127 - DNA, 1441 bp, Aerococcus sp. HMSC23C02
  ref <308>: DATABASE ACCESSION NUMBER: NCBI ACCESSION: NZ_KV786042.1
  ref <309>: DATABASE ENTRY DATE: 2019-04-01
  ref <313>: RELEVANT RESIDUES IN SEQ ID NO: (1)..(1441)
aacacgtaaggaacctacctatgagcgggggacaacatccggaaacgggtgctaataccgcatagtaatttgtcaggcatctgacaaattggaaagacggcttttgctgtcactcatagatggtcttgcggtgcattagctagttggtgggataaaagcttaccaaggccatgatgcatagccgacctgagagggtaatcggccacactgggactgagacacggcccagactcctacgggaggcagcagtagggaatcttccgcaatgggcgcaagcctgacggagcaatgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtgcagaagaggaaagtggaactccatgtgtagcggtggaatgcgtagatatatggaagaacaccagtggcgaaggcgactttctggtctgtaactgacactgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcatttagttgggcactctagcgagactgccggtgacaaaccggaggaaggcggggatgacgtcaaatcatcatgccccttatgacttgggctacacacgtgctacaatggatggtacaacgggttgcgaactcgcgagagtcagcgaatcccttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaagga

SEQ ID NO: 1128 - DNA, 1043 bp, Aerococcus sp. SJQ22
  ref <308>: DATABASE ACCESSION NUMBER: NCBI ACCESSION: NZ_RKMG01000077.1
  ref <309>: DATABASE ENTRY DATE: 2019-04-01
  ref <313>: RELEVANT RESIDUES IN SEQ ID NO: (1)..(1043)
tttcatgagagtttgatcctggctcaggacgaacgctggcggcatgcctaatacatgcaagtcgtgcgaactgacgaagtacttgtacttttgacgttagcggcgaacgggtgagtaacacgtaaggaatctacctataagcgggggataacattcggaaacggatgctaataccgcataatacatatttccgcatggaaatacgttgaaagacggctctgctgtcacttatagatgaccttgcggtgcattagttagttggtggggtaatggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcgggg

SEQ ID NO: 1129 - DNA, 1558 bp, Aerococcus urinaeequi
  ref <308>: DATABASE ACCESSION NUMBER: NCBI ACCESSION: NZ_MDRY01000021.1
  ref <309>: DATABASE ENTRY DATE: 2019-04-01
  ref <313>: RELEVANT RESIDUES IN SEQ ID NO: (1)..(1558)
tttcatgagagtttgatcctggctcaggacgaacgctggcggcatgcctaatacatgcaagtcgagcgaacagatgaagtgcttgcacttctgacgttagcggcgaacgggtgagtaacacgtaaggaatctacctataagcgggggataacattcggaaacgggtgctaataccgcataatatcttcttccgcatggaagaagattgaaagacggctctgctgtcacttatagatgaccttgcggtgcattagttagttggtggggtaacggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcatttagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggaa

SEQ ID NO: 1130 - DNA, 1133 bp, Aerococcus urinaehominis
  ref <308>: DATABASE ACCESSION NUMBER: NCBI ACCESSION: NZ_FNHJ01000042.1
  ref <309>: DATABASE ENTRY DATE: 2019-04-01
  ref <313>: RELEVANT RESIDUES IN SEQ ID NO: (1)..(1133)
ggttttcggatcgtaaaactctgttgtgagtgaagaacaagttgtaattaactactacaaccttgacggtagctcaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggaaggtcattggaaactggggaacttgagtgcagaagaggaaagtggaattccatgtgtagcggtggaatgcgtagatatatggaggaacaccagtggcgaaggcgactttctggtctgtaactgacactgaggctcgaaagcgtggggagcaaacaggattagataccctggtagtccacgccgtaaacgatgagtgctaggtgttggagggtttccacccttcagtgccgcagttaacgcaataagcactccgcctggggagtacggccgcaaggctgaaactcaaaggaattgacggggacccgcacaagcggtggagcatgtggtttaattcgaagcaacgcgaagaaccttaccaagtcttgacatcctctgaccaccctagagatagggctttcccttcggggacagagtgacaggtggtgcatggttgtcgtcagctcgtgtcgtgagatgttgggttaagtcccgcaacgagcgcaacccttatcgttagttgccagcattcagttgggcactctagcgagactgccggtgacaaaccggaggaaggtggggatgacgtcaaatcatcatgccccttatgacttgggctacacacgtgctacaatggatggtacaacgagccgcaaactcgcgagggtaagcaaatctcttaaagccattctcagttcggattgtagtctgcaactcgactacatgaagccggaatcgctagtaatcgtggatcagcacgccacggtgaatacgttcccgggtcttgtacacaccgcccgtcacaccacgagagtttgtaacacccgaagtcggtgaggtaaccttttggagccagccgccgaaggtgggacagataattggggtgaagtcgtaacaaggtagccgtatcggaaggtgcggctggatcacctcctttctaagga

SEQ ID NO: 1131 - DNA, 1558 bp, Aerococcus viridans
  ref <308>: DATABASE ACCESSION NUMBER: NCBI ACCESSION: NZ_UAPS01000002.1
  ref <309>: DATABASE ENTRY DATE: 2019-04-01
  ref <313>: RELEVANT RESIDUES IN SEQ ID NO: (1)..(1558)
tttcatgagagtttgatcctggctcaggacgaacgctggcggcatgcctaatacatgcaagtcgagcgaacagatgaagtgcttgcacttctgacgttagcggcgaacgggtgagtaacacgtaaggaatctacctataagcgggggataacattcggaaacgggtgctaataccgcataatattttcttccgcatggaagaaaattgaaagacggctctgctgtcacttatagatgaccttgcggtgcattagttagttggtggggtaatggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaaattgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggttttcccttcggggacaaagtgacaggtggtgcatggttgtcgtcagctcgtgtcgtgagatgttgggttaagtcccgcaacgagcgcaacccctattattagttgccagcatttagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagccgccgaaggtgggacagacgattggggtgaagtcgtaacaaggtagccgtatcggaaggtgcggctggatcacctcctttctaaggaa

SEQ ID NO: 1132 - DNA, 1529 bp, Aeromicrobium camelliae
  ref <308>: DATABASE ACCESSION NUMBER: NCBI ACCESSION: NZ_RQJX01000032.1
  ref <309>: DATABASE ENTRY DATE: 2019-04-01
  ref <313>: RELEVANT RESIDUES IN SEQ ID NO: (1)..(1529)
ttcaacggagagtttgatcctggctcaggacgaacgctggcggcgtgcttaacacatgcaagtcgagcggtaaggcccctttcggggggtacacgagcggcgaacgggtgagtaacacgtgagcaacctgcccttctctttgggataaccagtggaaacgctggctaataccgaatatgaccgccttgggcatccggggtggtggaaagttccggcggagaaggatgggctcgcggcctatcagcttgttggtgaggtaatggctcaccaaggcgacgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcaccgacgaagcgaaagtgacggtaggtgcagaagaaggaccggccaactacgtgccagcagccgcggtaatacgtagggtccgagcgttgtccggaattattgggcgtaaagggctcgtaggcggtctgtcgcgtcgggagtgaaaactcggggcttaaccccgagcgtgcttccgatacgggcagactagagggatgcaggggagaatggaattcctggtgtagcggtggaatgcgcagatatcaggaggaacaccggtggcgaaggcggttctctgggcatttcctgacgctgaggagcgaaagcatggggagcgaacaggattagataccctggtagtccatgccgtaaacgttgggcgctaggtgtggggaccttccacggtttccgtgccgcagctaacgcattaagcgccccgcctggggagtacggccgcaaggctaaaactcaaaggaattgacgggggcccgcacaagcggcggagcatgctgattaattcgatgcaacgcgaagaaccttacctgggtttgacatatgccggaaagctgcagagatgtggcctcccttgtggccggtatacaggtggtgcatggctgtcgtcagctcgtgtcgtgagatgttgggttaagtcccgcaacgagcgcaaccctcgtcctatgttgccagcacgtgatggtggggactcataggagactgccggggtcaactcggaggaaggtggggatgacgtcaagtcttcatgccccttatgtccagggcttcaagcatgctacaatggccggtacaatgggctgcgaaatcgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggcaacacccgaagccggtggcctaacccttgtgggaggagccgtcgaaggtggggctggcgattgggacgaagtcgtaacaaggtagccgtaccggaaggtgcggctggatcacctcctttctaaggag

SEQ ID NO: 1133 - DNA, 1528 bp, Aeromicrobium fastidiosum
  ref <308>: DATABASE ACCESSION NUMBER: NCBI ACCESSION: NZ_SDPP01000008.1
  ref <309>: DATABASE ENTRY DATE: 2019-04-01
  ref <313>: RELEVANT RESIDUES IN SEQ ID NO: (1)..(1528)
ttcaatggagagtttgatcctggctcaggacgaacgctggcggcgtgcttaacacatgcaagtcgagcggtaaggcccttcggggtacacgagcggcgaacgggtgagtaacacgtgagcaatctgcccttctctttggaataaccattggaaacgatggctaatgccgaatatgaacccctttcgcatgttgggggttggaaagctccggcggagaaggatgagctcgcggcctatcagcttgttggtgaggtaatggctcaccaaggcattgacgggtagccggcctgagagggtgaccggccacactgggactgagacacggcccagactcctacgggaggcagcagtggggaatattggacaatgggcgaaagcctgatccagcaacgccgcgtgagggatgaaggccttcgggttgtaaacctctttcagcagggacgaagcgagagtgacggtacctgcagaagaaggaccggccaactacgtgccagcagccgcggtaatacgtagggtccgagcgttgtccggaattattgggcgtaaagggctcgtaggcggtttgtcgcgtcgggagtgaaaactcagggctcaaccctgagcgtgcttccgatacgggcagactagaggtattcaggggagaacggaattcctggtgtagcggtggaatgcgcagatatcaggaggaacaccggtggcgaaggcggttctctgggaattacctgacgctgaggagcgaaagcatggggagcgaacaggattagataccctggtagtccatgccgtaaacgttgggcgctaggtgtggggaccttccacggtttccgtgccgcagctaacgcattaagcgccccgcctggggagtacggccgcaaggctaaaactcaaaggaattgacgggggcccgcacaagcggcggagcatgctgattaattcgatgcaacgcgaagaaccttacctgggtttgacatatgccggaaagctgcagagatgtggccccccttgtggtcggtatacaggtggtgcatggctgtcgtcagctcgtgtcgtgagatgttgggttaagtcccgcaacgagcgcaaccctcgttctatgttgccagcacgttatggtggggactcataggagactgccggggtcaactcggaggaaggtggggatgacgtcaagtcttcatgccccttatgtccagggcttcaagcatgctacaatggccggtacaaagggctgcgaaaccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggcaacacccgaagccagtggcccaaccgtttacggagggagctgtcgaaggtggggctggcgattgggacgaagtcgtaacaaggtagccgtaccggaaggtgcggctggatcacctcctttctaaggagca

SEQ ID NO: 1134 - DNA, 1528 bp, Aeromicrobium ginsengisoli; identical to SEQ ID NO: 1133
  ref <308>: DATABASE ACCESSION NUMBER: NCBI ACCESSION: NZ_SDPQ01000007.1
  ref <309>: DATABASE ENTRY DATE: 2019-04-01
  ref <313>: RELEVANT RESIDUES IN SEQ ID NO: (1)..(1528)

SEQ ID NO: 1135 - DNA, 1529 bp, Aeromicrobium sp. 9W16Y-2
  ref <308>: DATABASE ACCESSION NUMBER: NCBI ACCESSION: NZ_RDBF01000019.1
  ref <309>: DATABASE ENTRY DATE: 2019-04-01
  ref <313>: RELEVANT RESIDUES IN SEQ ID NO: (1)..(1529)
ttcaacggagagtttgatcctggctcaggacgaacgctggcggcgtgcttaacacatgcaagtcgagcggtaaggcccctttcggggggtacacgagcggcgaacgggtgagtaacacgtgagcaacctgcccttctcttggggataaccagtggaaacgctggctaataccgaatatgactgcttcgcgcatgcggggtggtggaaagttccggcggagaaggatgggctcgcggcctatcagcttgttggtgaggtaatggctcaccaaggcgacgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcaccgacgaagcgagagtgacggtaggtgcagaagaaggaccggccaactacgtgccagcagccgcggtaatacgtagggtccgagcgttgtccggaattattgggcgtaaagggctcgtaggcggtctgtcgcgtcgggagtgaaaactcggggcttaaccccgagcgtgcttccgatacgggcagactagagggatgcaggggagaatggaattcctggtgtagcggtggaatgcgcagatatcaggaggaacaccggtggcgaaggcggttctctgggcatttcctgacgctgaggagcgaaagcatggggagcgaacaggattagataccctggtagtccatgccgtaaacgttgggcgctaggtgtggggaccttccacggtttccgtgccgcagctaacgcattaagcgccccgcctggggagtacggccgcaaggctaaaactcaaaggaattgacgggggcccgcacaagcggcggagcatgctgattaattcgatgcaacgcgaagaaccttacctgggtttgacatatgccggaaagctgcagagatgtggcctcccttgtggccggtatacaggtggtgcatggctgtcgtcagctcgtgtcgtgagatgttgggttaagtcccgcaacgagcgcaaccctcgtcctatgttgccagcacgtgatggtggggactcataggagactgccggggtcaactcggaggaaggtggggatgacgtcaagtcttcatgccccttatgtccagggcttcaagcatgctacaatggccggtacaatgggctgcgaagccgtgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggcaacacccgaagccggtggcctaacccttgtggggggagccgtcgaaggtggggctggcgattgggacgaagtcgtaacaaggtagccgtaccggaaggtgcggctggatcacctcctttctaaggag

SEQ ID NO: 1136 - DNA, 1528 bp, Aeromicrobium sp. A1-2
  ref <308>: DATABASE ACCESSION NUMBER: NCBI ACCESSION: NZ_CP027482.1
  ref <309>: DATABASE ENTRY DATE: 2019-04-01
  ref <313>: RELEVANT RESIDUES IN SEQ ID NO: (1)..(1528)
ttcaacggagagtttgatcctggctcaggacgaacgctggcggcgtgcttaacacatgcaagtcgagcggtaaggctccttcgggagtacacgagcggcgaacgggtgagtaacacgtgagcaatctgcccttctctttggaataaccattggaaacgatggctaatgccgaatatgacttcggaccgcatggtctggagtggaaagctccggcggagaaggatgagctcgcggcctatcagcttgttggtgaggtaatggctcaccaaggcattgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcagggacgaagcgaaagtgacggtacctgcagaagaaggaccggccaactacgtgccagcagccgcggtaatacgtagggtccgagcgttgtccggaattattgggcgtaaagggctcgtaggcggtttgtcgcgtcgggagtgaaaactcagggctcaaccctgagcgtgcttccgatacgggcagactagaggtatgcaggggagaacggaattcctggtgtagcggtggaatgcgcagatatcaggaggaacaccggtggcgaaggcggttctctgggcattacctgacgctgaggagcgaaagcatggggagcgaacaggattagataccctggtagtccatgccgtaaacgttgggcgctaggtgtggggaccttccacggtctccgtgccgcagctaacgcattaagcgccccgcctggggagtacggccgcaaggctaaaactcaaaggaattgacgggggcccgcacaagcggcggagcatgctgattaattcgatgcaacgcgaagaaccttacctgggtttgacatatgccggaaagccgtagagatacggcccccttgtggtcggtttacaggtggtgcatggctgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaagtcttcatgcccttatgtccagggcttcaagcatgctacaatggccggtacaaagggctgcgaaaccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggcaacacccgaagccagtggcccaaccgtttacggagggagctgtcgaaggtggggctggcgattgggacgaagtcgtaacaaggtagccgtaccggaaggtgcggctggatcacctcctttctaaggagca

SEQ ID NO: 1137 - DNA, 1527 bp, Aeromicrobium sp. M2KJ-4
  ref <308>: DATABASE ACCESSION NUMBER: NCBI ACCESSION: NZ_QUBR01000004.1
  ref <309>: DATABASE ENTRY DATE: 2019-04-01
  ref <313>: RELEVANT RESIDUES IN SEQ ID NO: (1)..(1527)
ttcaacggagagtttgatcctggctcaggacgaacgctggcggcgtgcttaacacatgcaagtcgagcggtaaggcccttcggggtacacgagcggcgaacgggtgagtaacacgtgagcaatctgcccttctctttggaataaccattggaaacgatggctaatgccgaatatgacctcctttcgcatgtttggaggtggaaagctccggcggagatggatgagctcgcggcctatcagcttgttggtgaggtaatggctcaccaaggcattgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcagggacgaagcgagagtgacggtacctgcagaagaaggaccggccaactacgtgccagcagccgcggtaatacgtagggtccgagcgttgtccggaattattgggcgtaaagggctcgtaggcggtttgtcgcgtcgggagtgaaaactcagggctcaaccctgagcgtgcttccgatacgggcagactagaggtatgcaggggagaacggaattcctggtgtagcggtggaatgcgcagatatcaggaggaacaccggtggcgaaggcggttctctgggcattacctgacgctgaggagcgaaagcgtggggagcgaacaggattagataccctggtagtccatgccgtaaacgttgggcgctaggtgtggggaccttccacggtttccgtgccgcagctaacgcattaagcgccccgcctggggagtacggccgcaaggctaaaactcaaaggaattgacgggggcccgcacaagcggcggagcatgctgattaattcgatgcaacgcgaagaaccttacctgggtttgacatatgccggaaagctgcagagatgtggcctccttttggtcggtatacaggtggtgcatggctgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaagtcttcatgccccttatgtccagggcttcaagcatgctacaatggccggtacaaagggctgcgaaactgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggcaacacccgaagccagtggcccaaccgtttacggagggagctgtcgaaggtggggctggcgattgggacgaagtcgtaacaaggtagccgtaccggaaggtgcggctggatcacctcctttctaaggagca

SEQ ID NO: 1138 - DNA, 1551 bp, Aeromonas bestiarum
  ref <308>: DATABASE ACCESSION NUMBER: NCBI ACCESSION: NZ_PPUX01000018.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacgactgctaataccgcatacgccctacgggggaaaggaggggaccttcgggcctttcgcgattggatgaacccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggcgcctaatacgtgtcaactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcgaatcagaatgtcgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1139 - DNA, 1431 bp, Aeromonas dhakensis
  ref <308>: DATABASE ACCESSION NUMBER: NCBI ACCESSION: NZ_PJOL01000128.1
  ref <309>: DATABASE ENTRY DATE: 2019-04-01
  ref <313>: RELEVANT RESIDUES IN SEQ ID NO: (1)..(1431)
aaattgaagagtttgatcatggctcagattgaacgctggcggcaggcctaacacatgcaagtcgagcggcagcgggaaagtagcttgctactgggccttgcgcgattggatatgcccaggtgggattagctagttggtgaggtaatggctcaccaaggcgacgatccctagctggtctgagaggatgatcagccacactggaactgagacacggtccagactcctacgggrggcagcagtggggaatattgsacaatgggsgmaascctgatscagccatgccgcgtgwgtgaagaaggccttcgggttgtaaagcactttcagcgaggaggaaaggtcagtagctaatatctgctgactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgyagagatrcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggattggagtctgcaactcgactccatgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1140 - DNA, 1551 bp, Aeromonas diversa
  ref <308>: DATABASE ACCESSION NUMBER: NCBI ACCESSION: NZ_QIMH01000022.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataactactggaaacggtagctaataccgcatacgccctacgggggaaagcaggggaccttcgggccttgcgcgattggatgaacccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggtagctaataactgccagctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1141 - DNA, 1551 bp, Aeromonas jandaei
  ref <308>: DATABASE ACCESSION NUMBER: NCBI ACCESSION: NZ_RQKB01000058.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataactactggaaacggtagctaataccgcatacgccctacgggggaaagcaggggaccttcgggccttgcgcgattggatgaacccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatatctgctggctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1142 - DNA, 1551 bp, Aeromonas lusitana
  ref <308>: DATABASE ACCESSION NUMBER: NCBI ACCESSION: NZ_PGCP01000030.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacggctgctaataccgcatacgccctacgggggaaagcaggggaccttcgggccttgcgcgattggatgaacccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtggctaataactactggctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacaaagggctgcaagctagcgatagtgagcgaatcccagaaagcgcgtcgtagtccggatcggagtctgcaactcgactccgtgaagtcggaatcgctagtaatcgcgaatcagaatgtcgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1143 - DNA, 1551 bp, Aeromonas salmonicida
  ref <308>: DATABASE ACCESSION NUMBER: NCBI ACCESSION: NZ_UETH01000022.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacgactgctaataccgcatacgccctacgggggaaaggaggggaccttcgggcctttcgcgattggatgaacccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggcgcctaatacgtgtcaactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcgaatcagaatgtcgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1144 - DNA, 1551 bp, Aeromonas sobria
  ref <308>: DATABASE ACCESSION NUMBER: NCBI ACCESSION: NZ_NQML01000098.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacgactgctaataccgcatacgccctacgggggaaaggaggggaccttcgggcctttcgcgattggatgaacccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggcagctaatatctgtcagctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgttcagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1145 - DNA, 1558 bp, Aeromonas sp. A35 P
  ref <308>: DATABASE ACCESSION NUMBER: NCBI ACCESSION: NZ_NEVB01000111.1
  ref <309>: DATABASE ENTRY DATE: 2019-04-01
  ref <313>: RELEVANT RESIDUES IN SEQ ID NO: (1)..(1558)
acttaaattgaagagtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgccctacgggggaaagcaggggaccttcgggccttgcgcgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatatctgctgactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctgggatcctgtagaaatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggattggagtctgcaactcgactccatgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaatga

SEQ ID NO: 1146 - DNA, 1551 bp, Aeromonas sp. ASNIH4
  ref <308>: DATABASE ACCESSION NUMBER: NCBI ACCESSION: NZ_CP026217.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgccctacgggggaaagcaggggaccttcgggccttgcgcgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttgatgcctaatacgtatcaactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1147 - DNA, 1551 bp, Aeromonas sp. ASNIH6; identical to SEQ ID NO: 1146
  ref <308>: DATABASE ACCESSION NUMBER: NCBI ACCESSION: NZ_PQLM01000103.1
  ref <309>: DATABASE ENTRY DATE: 2019-04-01
  ref <313>: RELEVANT RESIDUES IN SEQ ID NO: (1)..(1551)

SEQ ID NO: 1148 - DNA, 1575 bp, Aeromonas sp. CA23
  ref <308>: DATABASE ACCESSION NUMBER: NCBI ACCESSION: NZ_CP023818.1
  ref <309>: DATABASE ENTRY DATE: 2019-04-01
  ref <313>: RELEVANT RESIDUES IN SEQ ID NO: (1)..(1575)
acttaaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacgactgctaataccgcatacgccctacgggggaaaggaggggaccttcgggcctttcgcgattggatgaacccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggcgcctaatacgtgtcaactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcgaatcagaatgtcgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctagccccccccccccccccctaggggaacctggggttggatcacctccttaccttaa

SEQ ID NO: 1149 - DNA, 1558 bp, Aeromonas sp. CU5
  ref <308>: DATABASE ACCESSION NUMBER: NCBI ACCESSION: NZ_CP023817.1
  ref <309>: DATABASE ENTRY DATE: 2019-04-01
  ref <313>: RELEVANT RESIDUES IN SEQ ID NO: (1)..(1558)
acttaaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacgactgctaataccgcatacgccctacgggggaaaggaggggaccttcgggcctttcgcgattggatgaacccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggcagctaatatttgtcagctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgttcagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaaaga

SEQ ID NO: 1150 - DNA, 1073 bp, Aeromonas sp. HMWF014
  ref <308>: DATABASE ACCESSION NUMBER: NCBI ACCESSION: NZ_QAIP01000426.1
  ref <309>: DATABASE ENTRY DATE: 2019-04-01
  ref <313>: RELEVANT RESIDUES IN SEQ ID NO: (1)..(1073)
ctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1151 - DNA, 1551 bp, Aeromonas sp. HMWF016
  ref <308>: DATABASE ACCESSION NUMBER: NCBI ACCESSION: NZ_QAIN01000123.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataactactggaaacggtagctaataccgcatacgccctacgggggaaagcaggggaccttcgggccttgcgcgattggatgaacccaggtgggattagctagttggtgaggtaacggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggtagctaatatctgccagctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatccctgagagattggggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1152 - DNA, 1551 bp, Aeromonas sp. HMWF017
  ref <308>: DATABASE ACCESSION NUMBER: NCBI ACCESSION: NZ_QAJD01000017.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataactactggaaacggtagctaataccgcatacgccctacgggggaaagcaggggaccttcgggccttgcgcgattggatgaacccaggtgggattagctagttggtgaggtaacggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggtagctaataactgccagctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaa

SEQ ID NO: 1153 - DNA, 1551 bp, Aeromonas sp. HMWF036; identical to SEQ ID NO: 1152
  ref <308>: DATABASE ACCESSION NUMBER: NCBI ACCESSION: NZ_QAIE01000021.1
  ref <309>: DATABASE ENTRY DATE: 2019-04-01
  ref <313>: RELEVANT RESIDUES IN SEQ ID NO: (1)..(1551)

SEQ ID NO: 1154 - DNA, 1554 bp, Aeromonas sp. MDS8
  ref <308>: DATABASE ACCESSION NUMBER: NCBI ACCESSION: NZ_AOTK01000108.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgccctacgggggaaagcaggggaccttcgggccttgcgcgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatatctgctgactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggattggagtctgcaactcgactccatgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttaccttaatga

SEQ ID NO: 1155 - DNA, 1551 bp, Aeromonas veronii; identical to SEQ ID NO: 1140
  ref <308>: DATABASE ACCESSION NUMBER: NCBI ACCESSION: NZ_UETI01000032.1
  ref <309>: DATABASE ENTRY DATE: 2019-04-01
  ref <313>: RELEVANT RESIDUES IN SEQ ID NO: (1)..(1551)

SEQ ID NO: 1156 - DNA, 1501 bp, Aestuariispira insulae
  ref <308>: DATABASE ACCESSION NUMBER: NCBI ACCESSION: NZ_QRDW01000028.1
  ref <309>: DATABASE ENTRY DATE: 2019-04-01
  ref <313>: RELEVANT RESIDUES IN SEQ ID NO: (1)..(1501)
gaacctgagagtttgatcctggctcagaacgaacgctggcggcaggcctaacacatgcaagtcgagcgagaaggcatcttcgggtgctgggcagcggcggacgggtgagtaacgcgtgggaacatacctttcggtgggggacaacagttggaaacgactgctaataccgcatacgcccttcgggggaaagatttatcgccgagagattggcccgcgttagattaggtagttggtgaggtaacggctcaccaagccgacgatctatagctggtctgagaggatgatcagccacactgggactgagacacggcccagactcctacgggaggcagcagtggggaatattgcgcaatggaggaaactctgacgcagccatgccgcgtgagtgaagaaggccttagggttgtaaagctctttcaatagtgaagatgatgacggtaactatagaagaagctccggctaacttcgtgccagcagccgcggtaatacgaagggagcaagcgttgttcggaattactgggcgtaaagggcgtgtaggcggactgtccagtcaggggtgaaatcccggggctcaacctcggaactgcctttgatactgacagtctagagtccgcgagaggatagtggaatacccagtgtagaggtgaaattcgtagatattgggtagaacaccagtggcgaaggcgactatctggagcggtactgacgctgaggcgcgaaagcgtggggagcaaacaggattagataccctggtagtccacgccgtaaacgatgtgaactagtcgtcggggtttagacttcggtgacgcagctaacgcattaagttcaccgcctggggagtacggtcgcaagattaaaactcaaaggaattgacgggggcccgcacaagcggtggagcatgtggtttaattcgaagcaacgcgcagaaccttaccaacccttgacatccctatcgcggttaccagagatggtttccttcagttcggctggataggtgacaggtgctgcatggctgtcgtcagctcgtgtcgtgagatgttgggttaagtcccgcaacgagcgcaacccccgcccttagttgccatcattaagttgggcactctaggggaactgccggtgacaagccggaggaaggcggggatgacgtcaagtcctcatggcccttatgggttgggctacacacgtgctacaatggctactacagagggcagctactcagcgatgaggtgctaatcccaaaaagtagtctcagttcggattgttctctgcaactcgagagcatgaagtcggaatcgctagtaatcgtggatcagcatgccacggtgaatacgttcccgggccttgtacacaccgcccgtcacaccatgggagttggttctacccgaagccggtgcgctaaccttttagggggcagccgaccacggtagggtcagcgactggggtgaagtcgtaacaaggtagccgtaggggaacctgcggctggatcacctcctttctaagg

SEQ ID NO: 1157 - DNA, 1425 bp, Aestuariivita boseongensis
  ref <308>: DATABASE ACCESSION NUMBER: NCBI ACCESSION: NZ_JXYH01000050.1
  ref <309>: DATABASE ENTRY DATE: 2019-04-01
  ref <313>: RELEVANT RESIDUES IN SEQ ID NO: (1)..(1425)
tcaacttgagagtttgatcctggctcagaacgaacgctggcggcaggcctaacacatgcaagtcgagcgcaccttcgggtgagcggcggacgggttagtaacgcgtgggaacgtgcccagatctaaggaatagcctcgggaaactgagagtaataccttatacgcccttcgggggaaagatttatcggatttggatcggcccgcgttagattaggtagttggtggggtaatggcctaccaagcctacgatctatagctggttttagaggatgatcagcaacactgggactgagacacggcccagactcctacgggaggcagcagtggggaatcttagacaatgggggaaaccctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcctttgatactggtagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcggatagcatgctattcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtggtgacagtgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctctctgagggggcagcggaccacggtgagctcagcgactggggtgaagtcgtaacaa

SEQ ID NO: 1158 - DNA, 1474 bp, Afifella pfennigii
  ref <308>: DATABASE ACCESSION NUMBER: NCBI ACCESSION: NZ_JHZK01000050.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcttaacacatgcaagtcgaacgcgctcttcggagcgagtggcagacgggtgagtaacgcgtgggaatctacccaatggtacgggataacccgaggaaactcgagctaataccgtatacgcccttcgggggaaagatttatcgccattggatgagcccgcgtcggattagcttgttggtggggtaatggcctaccaaggcgacgatccgtagctggtctgagaggatgatcagccacactgggactgagacacggcccagactcctacgggaggcagcagtggggaatcttggacaatgggcgaaagcctgatccagccatgccgcgtgagtgaagaaggccctagggttgtaaagctctttcagcggggaagataatgacggtacccgcagaagaagccccggctaacttcgtgccagcagccgcggtaatacgaagggggctagcgttgttcggaattactgggcgtaaagcgcgcgtaggcggattgttaagtcaggggtgaaatcccgaggctcaacctcggaactgcctctgatactggcaatctcgagtccggaagaggttggtggaattccgagtgtagaggtgaaattcgtagatattcggaggaacaccagaggcgaaggcggccaactggtccgagactgacgctgaggcgcgaaagcgtggggagcaaacaggattagataccctggtagtccacgccgtaaacgatggatgctagccgttggtgggtatactcatcagtggcgcagctaacgcattaagcatcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttaggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggcggtgacagtgggaaaatccccaaaaaccgtctcagttcggattgtcctctgcaactcgagggcatgaaggtggaatcgctagtaatcgtggatcagcatgccacggtgaatacgttcccgggccttgtacacaccgcccgtcacaccatgggagttggttctacccgaagacggtgcgctaacccgcaagggaggcagccggccacggtagggtcagcgactggggtgaagtcgtaacaaggtagccgtaggggaacctgcggctggatcacctcctttctaagg

SEQ ID NO: 1159 - DNA, 1472 bp, Afifella sp. JA968
  ref <308>: DATABASE ACCESSION NUMBER: NCBI ACCESSION: NZ_SAUF01000001.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcttaacacatgcaagtcgaacgcactcttcggagtgagtggcagacgggtgagtaacgcgtgggaatctacccagtggtacgggataacccgaggaaactcgagctaataccgtatacgcccttcgggggaaagatttattgccattggatgagcccgcgtcggattagcttgttggtggggtaacggcctaccaaggcaacgatccgtagctggtctgagaggatgatcagccacactgggactgagacacggcccagactcctacgggaggcagcagtggggaatcttggacaatgggggaaaccctgatccagccatgccgcgtgagtgaagaaggccctagggttgtaaagctctttcagcggggaagataatgacggtacccgcagaagaagccccggctaacttcgtgccagcagccgcggtaatacgaagggggctagcgttgttcggaattactgggcgtaaagcgcgcgtaggcggattgttaagtcaggggtgaaatcccagagctcaactctggaactgcctctgatactggcaatctcgagtccggaagaggttggtggaattccgagtgtagaggtgaaattcgtagatattcggaggaacaccagaggcgaaggcggccaactggtccgagactgacgctgaggcgcgaaagcgtggggagcaaacaggattagataccctggtagtccacgccgtaaacgatggatgctagccgttggtgggtatactcatcagtggcgcagctaacgcattaagcatcccgcctggggagtacggtcgcaagattaaaactcaaaggaattgacgggggcccgcacaagcggtggagcatgtggtttaattcgaagcaacgcgcagaaccttaccagctcttgacatcccgatcgcggttaccggagacggtttccttcagctaggctggatcggtgacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggcggtgacagtgggaaaatccccaaaaaccgtctcagttcggattgtcctctgcaactcgggggcatgaaggtggaatcgctagtaatcgtggatcagcatgccacggtgaatacgttcccgggccttgtacacaccgcccgtcacaccatgggagttggttctacccgaagacggtgcgctaacccgcaagggaggcagccggccacggtagggtcagcgactggggtgaagtcgtaacaaggtagccgtaggggaacctgcggctggatcacctcctttctaa

SEQ ID NO: 1160 - DNA, 1497 bp, Afipia birgiae
  ref <308>: DATABASE ACCESSION NUMBER: NCBI ACCESSION: NZ_HG326655.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttgggaagtttacttttcagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctatgaccggcaccagagatggagccttcccttcggggcatagagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 1161 - DNA, 1491 bp, Afipia broomeae
  ref <308>: DATABASE ACCESSION NUMBER: NCBI ACCESSION: NZ_PGEV01000001.1
  ref <309>: DATABASE ENTRY DATE: 2019-04-01
  ref <313>: RELEVANT RESIDUES IN SEQ ID NO: (1)..(1491)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccgggaccggtcgcagagacgcgaccttctcttcggagcccggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttct

SEQ ID NO: 1162 - DNA, 1497 bp, Afipia clevelandensis
  ref <308>: DATABASE ACCESSION NUMBER: NCBI ACCESSION: NZ_KB375281.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgaacgggcgtagcaatacgtcagtggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaagcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttggaaagtttacttttcagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcaaaggggcgacccctagcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 1163 - DNA, 1493 bp, Afipia felis
  ref <308>: DATABASE ACCESSION NUMBER: NCBI ACCESSION: NZ_UFSI01000001.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccgaataagcccttacggggaaagatttatcgccgaaagattggcccgcgtctgattagcttgttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaagcctggagctcaactccagaactgcctttgatactgaggatctcgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttggggagtttactcttcagtggcgcagttaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcaaaggcgcgagccctagcaaatctcaaaaagccgtctcagttcggattggactctgcaactcgagtccatgaagttggaatcgctagtaatcgtggatcagcatgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttct

SEQ ID NO: 1164 - DNA, 1497 bp, Afipia massiliensis
  ref <308>: DATABASE ACCESSION NUMBER: NCBI ACCESSION: NZ_LBIA01000001.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttggggagtttactcttcagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctatgaccggtaccagagatggaaccttcccttcggggcatagagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttctacctgaaggcagtgcgctaacccgcaagggaggcagctgaccacggtagggtcagcgactggggtgaagtcgtaacaaggtagccgtaggggaacctgcggctggatcacctcctttctaagg

SEQ ID NO: 1165 - DNA, 1495 bp, Afipia sp. 1NLS2
  ref <308>: DATABASE ACCESSION NUMBER: NCBI ACCESSION: NZ_ADVZ01000001.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgccgtagcaatacggagcggcagacgggtgagtaacgcgtgggaacgtaccttttggttcggaacaacacagggaaacttgtgctaataccgaataagcccttacggggaaagatttatcgccgaaagatcggcccgcgtctgattagcttgttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaagcctggagctcaactccagaactgcctttgatactgaggatctcgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttggggagtttactcttcagtggcgcagttaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcaaaggcgcgagccctagcaaatctcaaaaagccgtctcagttcggattggactctgcaactcgagtccatgaagttggaatcgctagtaatcgtggatcagcatgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 1166 - DNA, 1495 bp, Afipia sp. NBIMC P1-C1
  ref <308>: DATABASE ACCESSION NUMBER: NCBI ACCESSION: NZ_AVBK01000004.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttggaaagtttacttttcagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctatgaccggtaccagagatggaaccttcccttcggggcatagagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 1167 - DNA, 1495 bp, Afipia sp. NBIMC P1-C2; identical to SEQ ID NO: 1166
  ref <308>: DATABASE ACCESSION NUMBER: NCBI ACCESSION: NZ_AVBL01000011.1
  ref <309>: DATABASE ENTRY DATE: 2019-04-01
  ref <313>: RELEVANT RESIDUES IN SEQ ID NO: (1)..(1495)

SEQ ID NO: 1168 - DNA, 1495 bp, Afipia sp. NBIMC P1-C3; identical to SEQ ID NO: 1166
  ref <308>: DATABASE ACCESSION NUMBER: NCBI ACCESSION: NZ_AVBM01000004.1
  ref <309>: DATABASE ENTRY DATE: 2019-04-01
  ref <313>: RELEVANT RESIDUES IN SEQ ID NO: (1)..(1495)

SEQ ID NO: 1169 - DNA, 1495 bp, Afipia sp. OHSU I-C4
  ref <308>: DATABASE ACCESSION NUMBER: NCBI ACCESSION: NZ_APJF01000010.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttggaaagtttacttttcagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctatgaccggtaccagagatggaaccttcccttcggggcatagagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcatgccgcggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 1170 - DNA, 1495 bp, Afipia sp. OHSU I-C6; identical to SEQ ID NO: 1169
  ref <308>: DATABASE ACCESSION NUMBER: NCBI ACCESSION: NZ_APJE01000029.1
  ref <309>: DATABASE ENTRY DATE: 2019-04-01
  ref <313>: RELEVANT RESIDUES IN SEQ ID NO: (1)..(1495)

SEQ ID NO: 1171 - DNA, 1495 bp, Afipia sp. OHSU I-uncloned; identical to SEQ ID NO: 1169
  ref <308>: DATABASE ACCESSION NUMBER: NCBI ACCESSION: NZ_APJG01000003.1
  ref <309>: DATABASE ENTRY DATE: 2019-04-01
  ref <313>: RELEVANT RESIDUES IN SEQ ID NO: (1)..(1495)

SEQ ID NO: 1172 - DNA, 1495 bp, Afipia sp. OHSU II-C1; identical to SEQ ID NO: 1169
  ref <308>: DATABASE ACCESSION NUMBER: NCBI ACCESSION: NZ_APJI01000006.1
  ref <309>: DATABASE ENTRY DATE: 2019-04-01
  ref <313>: RELEVANT RESIDUES IN SEQ ID NO: (1)..(1495)

SEQ ID NO: 1173 - DNA, 1495 bp, Afipia sp. OHSU II-C2; identical to SEQ ID NO: 1169
  ref <308>: DATABASE ACCESSION NUMBER: NCBI ACCESSION: NZ_APJH01000012.1
  ref <309>: DATABASE ENTRY DATE: 2019-04-01
  ref <313>: RELEVANT RESIDUES IN SEQ ID NO: (1)..(1495)

SEQ ID NO: 1174 - DNA, 1495 bp, Afipia sp. OHSU II-uncloned; identical to SEQ ID NO: 1169
  ref <308>: DATABASE ACCESSION NUMBER: NCBI ACCESSION: NZ_APHQ01000008.1
  ref <309>: DATABASE ENTRY DATE: 2019-04-01
  ref <313>: RELEVANT RESIDUES IN SEQ ID NO: (1)..(1495)

SEQ ID NO: 1175 - DNA, 1495 bp, Afipia sp. P52-10
  ref <308>: DATABASE ACCESSION NUMBER: NCBI ACCESSION: NZ_AZSJ01000003.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgccgtagcaatacggagcggcagacgggtgagtaacacgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctcttttgtgcgggaagataatgactgtaccgcaagaataagccccggctaacttcgtgccagcagccgcggtaatacgaagggggctagcgttgctcggaatcactgggcgtaaagcgcacgtaggcggactcttaagtcggtggtgaaatcctggagctcaactccagaactgccttcgatactgggagtctcgagttcgggagaggtgagtggaactgcgagtgtagaggtgaaattcgtagatattcgcaagaacaccagtggcgaaggcggctcactggcccgatactgacgctgaggtgcgaaagcgtggggagcaaacaggattagataccctggtagtccacgccgtaaacgatgaatgctagccgttggtgggtttacccttcagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagctcttgacatgtccaggaccggtcgcagagatgtgactttcccttcggggcctggaacacaggtgctgcatggctgtcgtcagctcgtgtcgtgagatgttgggttaagtcccgcaacgagcgcaacccccgtccttagttgctaccattcagttgagcactctaaggagactgccggtgataagccgcgaggaaggtggggatgacgtcaagtcctcatggcccttacgggctgggctacacacgtgctacaatggcggtgacagagggacgcgaaggcgtgagccttggcaaatctcaaaaagccgtctcagttcggattgggctctgcaactcgagcccatgaagttggaatcgctagtaatcgcagatcagcatgctgcggtgaatacgttcccgggccttgtacacaccgcccgtcacaccatgggagttggctttacctgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 1176 - DNA, 1497 bp, Afipia sp. Root123D2
  ref <308>: DATABASE ACCESSION NUMBER: NCBI ACCESSION: NZ_LMDP01000003.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccaaaagatcggcccgcgtctgattagcttgttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgactgtaccgcaagaataagccccggctaacttcgtgccagcagccgcggtaatacgaagggggctagcgttgctcggaatcactgggcgtaaagggtgcgtaggtggatttttaagtcaggggtgaaatcctggagctcaactccagaactgcctttgatactgggaatcttgagttcgggagaggtgagtggaactgcgagtgtagaggtgaaattcgtagatattcgcaagaacaccagtggcgaaggcggctcactggcccgatactgacactgaggcacgaaagcgtggggagcaaacaggattagataccctggtagtccacgccgtaaacgatgaatgccagccgttggggagtttactcttcagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggagcaatccttcgcaaatctcaaaaagccgtctcagttcggattggactctgcaactcgagtccatgaagttggaatcgctagtaatcgtggatcagcatgccacggtgaatacgttcccgggccttgtacacaccgcccgtcacaccatgggagttggttttacctgaaggcggtgcgctaacccgcaagggaggcagccgaccacggtagggtcagcgactggggtgaagtcgtaacaaggtagccgtaggggaacctgcggctggatcacctcctttctaagg

SEQ ID NO: 1177 - DNA, 1536 bp, Agathobaculum butyriciproducens
  ref <308>: DATABASE ACCESSION NUMBER: NCBI ACCESSION: NZ_QVFF01000067.1
  ref <309>: DATABASE ENTRY DATE: 2019-04-01
  ref <313>: RELEVANT RESIDUES IN SEQ ID NO: (1)..(1536)
tttttagagagtttgatcctggctcaggatgaacgctggcggcgtgcctaacacatgcaagtcgaacggagtcgttttggaaatctcttcggagatggaattctcgacttagtggcggacgggtgagtaacgcgtgagcaatctgcctttaagagggggataacagtcggaaacggctgctaataccgcataaagcatcaaattcgcatgtttttgatgccaaaggagcaatccgcttttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggcctcgggttgtaaagatctttaatcagggacgaaacaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccgccttagagataaggcttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgagtccgtagcctaaccgtaaggagggcgcggccgaaggtaggggtggtaattagggtgaagtcgtaacaaggtagccgtatcggaaggtgcggctggatcacctcctttctaagga

SEQ ID NO: 1178 - DNA, 1538 bp, Agathobaculum sp. Marseille-P7918
  ref <308>: DATABASE ACCESSION NUMBER: NCBI ACCESSION: NZ_UYYD01000022.1
  ref <309>: DATABASE ENTRY DATE: 2019-04-01
  ref <313>: RELEVANT RESIDUES IN SEQ ID NO: (1)..(1538)
tttttagagagtttgatcctggctcaggatgaacgctggcggcgtgcctaacacatgcaagtcgaacggagttgtttaggaagtttccttcggggaacggatttctcaacttagtggcggacgggtgagtaacgcgtgagcaatctgcctttaggagggggataacagtcggaaacggctgctaataccgcataatgcatatccttcgcatgttggatatgccaaaggagcaatccgcctttagatgagctcgcgtctgattagctagttggcggggcaacggcccaccaaggcgacgatcagtagccggactgagaggttgaacggccacattgggactgagacacggcccagactcctacgggaggcagcagtggggaatattgcgcaatgggggcaaccctgacgcagcaacgccgcgtgattgaagaaggccttcgggttgtaaagatctttaatcagggacgaaaaatgacggtacctgaagaataagctccggctaactacgtgccagcagccgcggtaatacgtagggagcaagcgttatccggatttactgggtgtaaagggcgcgcaggcgggccggcaagttggaagtgaaatcccggggcttaaccccggaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggccttgacatcccgatgaccgtcctagagatagggcttctcttcggagcatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatggcctgggctacacacgtactacaatggcagtcatacagagggaagcaaaaccgcgaggtagagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgcaaggagggcgcggccgaaggtaggggtggtaattagggtgaagtcgtaacaaggtagccgtatcggaaggtgcggctggatcacctcctttctaagga

SEQ ID NO: 1179 - DNA, 1493 bp, Agrobacterium albertimagni
  ref <308>: DATABASE ACCESSION NUMBER: NCBI ACCESSION: NZ_ALJF01000029.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgccccgcaaggggagcggcagacgggtgagtaacgcgtgggaatctaccgtgccctacggaatagctccgggaaactggaattaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatccgggtcgcggacagtggagacattgtccttcagttaggctggacccaggacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaacccgcaagggaggcagctaaccacggtagggtcagcgactggggtgaagtcgtaacaaggtagccgtaggggaacctgcggctggatcacctcctttctaag

SEQ ID NO: 1180 - DNA, 1492 bp, Agrobacterium arsenijevicii
  ref <308>: DATABASE ACCESSION NUMBER: NCBI ACCESSION: NZ_JWIT01000061.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaatctaccgtgccctgcggaatagctccgggaaactggaattaataccgcatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 1181 - DNA, 1491 bp, Agrobacterium bohemicum
  ref <308>: DATABASE ACCESSION NUMBER: NCBI ACCESSION: NZ_PGEL01000020.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgcatcgcaagatgagtggcagacgggtgagtaacgcgtgggaatctacccatctctgcggaatagctctgggaaactggaattaataccgcatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtctactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaag

SEQ ID NO: 1182 - DNA, 1492 bp, Agrobacterium deltaense
  ref <308>: DATABASE ACCESSION NUMBER: NCBI ACCESSION: NZ_LT009748.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 1183 - DNA, 1492 bp, Agrobacterium fabrum
  ref <308>: DATABASE ACCESSION NUMBER: NCBI ACCESSION: NZ_LT009752.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaatctacccatctctgcggaatagctctgggaaactggaattaataccgcatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 1184 - DNA, 1492 bp, Agrobacterium genomosp. 13
  ref <308>: DATABASE ACCESSION NUMBER: NCBI ACCESSION: NZ_LT009756.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 1185 - DNA, 1492 bp, Agrobacterium genomosp. 2
  ref <308>: DATABASE ACCESSION NUMBER: NCBI ACCESSION: NZ_LT009718.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 1186 - DNA, 1492 bp, Agrobacterium genomosp. 3
  ref <308>: DATABASE ACCESSION NUMBER: NCBI ACCESSION: NZ_LT009723.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 1187 - DNA, 1492 bp, Agrobacterium genomosp. 5
  ref <308>: DATABASE ACCESSION NUMBER: NCBI ACCESSION: NZ_LT009735.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 1188 - DNA, 1491 bp, Agrobacterium larrymoorei
  ref <308>: DATABASE ACCESSION NUMBER: NCBI ACCESSION: NZ_JADW01000071.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaag

SEQ ID NO: 1189 - DNA, 1491 bp, Agrobacterium rhizogenes
  ref <308>: DATABASE ACCESSION NUMBER: NCBI ACCESSION: NZ_QDFR01000004.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaag

SEQ ID NO: 1190 - DNA, 1491 bp, Agrobacterium rosae
  ref <308>: DATABASE ACCESSION NUMBER: NCBI ACCESSION: NZ_PEQT01000022.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaatctacccatctctgcggaatagctctgggaaactggaattaataccgcatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtctactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaag

SEQ ID NO: 1191 - DNA, 1492 bp, Agrobacterium rubi
  ref <308>: DATABASE ACCESSION NUMBER: NCBI ACCESSION: NZ_LXKU01000014.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgaacgctccgcaaggagagtggcagacgggtgagtaacgcgtgggaatctacccaaccctgcggaatagctctgggaaactggaattaataccgcatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagttgactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaagg

SEQ ID NO: 1192 - DNA, 1491 bp, Agrobacterium salinitolerans
  ref <308>: DATABASE ACCESSION NUMBER: NCBI ACCESSION: NZ_LT009779.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 1193 - DNA, 1492 bp, Agrobacterium sp. 13-2099-1-2; identical to SEQ ID NO: 1180
  ref <308>: DATABASE ACCESSION NUMBER: NCBI ACCESSION: NZ_LXKL01000024.1
  ref <309>: DATABASE ENTRY DATE: 2019-04-01
  ref <313>: RELEVANT RESIDUES IN SEQ ID NO: (1)..(1492)

SEQ ID NO: 1194 - DNA, 1500 bp, Agrobacterium sp. 13-626
  ref <308>: DATABASE ACCESSION NUMBER: NCBI ACCESSION: NZ_LXKM01000028.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 1195 - DNA, 1492 bp, Agrobacterium sp. 224MFTsu3.1; identical to SEQ ID NO: 1186
  ref <308>: DATABASE ACCESSION NUMBER: NCBI ACCESSION: NZ_ARQL01000002.1
  ref <309>: DATABASE ENTRY DATE: 2019-04-01
  ref <313>: RELEVANT RESIDUES IN SEQ ID NO: (1)..(1492)

SEQ ID NO: 1196 - DNA, 1397 bp, Agrobacterium sp. 33MFTa1.1
  ref <308>: DATABASE ACCESSION NUMBER: NCBI ACCESSION: NZ_JNIC01000005.1
  ref <309>: DATABASE ENTRY DATE: 2019-04-01
  ref <313>: RELEVANT RESIDUES IN SEQ ID NO: (1)..(1397)
gagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 1197 - DNA, 1492 bp, Agrobacterium sp. ATCC 31749; identical to SEQ ID NO: 1183
  ref <308>: DATABASE ACCESSION NUMBER: NCBI ACCESSION: NZ_AECL01000040.1
  ref <309>: DATABASE ENTRY DATE: 2019-04-01
  ref <313>: RELEVANT RESIDUES IN SEQ ID NO: (1)..(1492)

SEQ ID NO: 1198 - DNA, 1500 bp, Agrobacterium sp. B131 95
  ref <308>: DATABASE ACCESSION NUMBER: NCBI ACCESSION: NZ_LXKP01000041.1
  ref <309>: DATABASE ENTRY DATE: 2019-04-01
  ref <313>: RELEVANT RESIDUES IN SEQ ID NO: (1)..(1500)
ttgaattctcaacatgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaagc

SEQ ID NO: 1199 - DNA, 1500 bp, Agrobacterium sp. B133 95; identical to SEQ ID NO: 1194
  ref <308>: DATABASE ACCESSION NUMBER: NCBI ACCESSION: NZ_LXKQ01000045.1
  ref <309>: DATABASE ENTRY DATE: 2019-04-01
  ref <313>: RELEVANT RESIDUES IN SEQ ID NO: (1)..(1500)

SEQ ID NO: 1200 - DNA, 1492 bp, Agrobacterium sp. C13; identical to SEQ ID NO: 1184
  ref <308>: DATABASE ACCESSION NUMBER: NCBI ACCESSION: NZ_ASYD01000034.1
  ref <309>: DATABASE ENTRY DATE: 2019-04-01
  ref <313>: RELEVANT RESIDUES IN SEQ ID NO: (1)..(1492)

SEQ ID NO: 1201 - DNA, 1491 bp, Agrobacterium sp. CNPSo 2736
  ref <308>: DATABASE ACCESSION NUMBER: NCBI ACCESSION: NZ_RZTX01000044.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 1202 - DNA, 1492 bp, Agrobacterium sp. D14; identical to SEQ ID NO: 1184
  ref <308>: DATABASE ACCESSION NUMBER: NCBI ACCESSION: NZ_ASXX01000040.1
  ref <309>: DATABASE ENTRY DATE: 2019-04-01
  ref <313>: RELEVANT RESIDUES IN SEQ ID NO: (1)..(1492)

SEQ ID NO: 1203 - DNA, 1491 bp, Agrobacterium sp. DSM 25558
  ref <308>: DATABASE ACCESSION NUMBER: NCBI ACCESSION: NZ_FMUD01000071.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaatctacccatctctgcggaatagctctgggaaactggaattaataccgcatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtctactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcattagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaagg

SEQ ID NO: 1204 - DNA, 1292 bp, Agrobacterium sp. DSM 25559
  ref <308>: DATABASE ACCESSION NUMBER: NCBI ACCESSION: NZ_FMUE01000005.1
  ref <309>: DATABASE ENTRY DATE: 2019-04-01
  ref <313>: RELEVANT RESIDUES IN SEQ ID NO: (1)..(1292)
tcaacttgagagtttgatcctggctcagaacgaacgctggcggcaggcttaacacatgcaagtcgaacgccccgcaaggggagtggcagacgggtgagtaacgcgtgggaatctacccatctctgcggaatagctctgggaaactggaattaataccgcatacgccctacgggggaaagatttatcggggatggatgagcccgcgttggattagctagttggtggggtaaaggcctacgaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtctactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacctgcggctggatcacctcctttctaagg

SEQ ID NO: 1205 - DNA, 1491 bp, Agrobacterium sp. FDAARGOS 525; identical to SEQ ID NO: 1192
  ref <308>: DATABASE ACCESSION NUMBER: NCBI ACCESSION: NZ_RKIU01000003.1
  ref <309>: DATABASE ENTRY DATE: 2019-04-01
  ref <313>: RELEVANT RESIDUES IN SEQ ID NO: (1)..(1491)

SEQ ID NO: 1206 - DNA, 1492 bp, Agrobacterium sp. H13-3; identical to SEQ ID NO: 1180
  ref <308>: DATABASE ACCESSION NUMBER: NCBI ACCESSION: NC_015508.1
  ref <309>: DATABASE ENTRY DATE: 2019-04-01
  ref <313>: RELEVANT RESIDUES IN SEQ ID NO: (1)..(1492)

SEQ ID NO: 1207 - DNA, 1492 bp, Agrobacterium sp. JL28; identical to SEQ ID NO: 1184
  ref <308>: DATABASE ACCESSION NUMBER: NCBI ACCESSION: NZ_ASXZ01000031.1
  ref <309>: DATABASE ENTRY DATE: 2019-04-01
  ref <313>: RELEVANT RESIDUES IN SEQ ID NO: (1)..(1492)

SEQ ID NO: 1208 - DNA, 746 bp, Agrobacterium sp. LAD9
  ref <308>: DATABASE ACCESSION NUMBER: NCBI ACCESSION: NZ_PHGS01000045.1
  ref <309>: DATABASE ENTRY DATE: 2019-04-01
  ref <313>: RELEVANT RESIDUES IN SEQ ID NO: (1)..(746)
tccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 1209 - DNA, 1492 bp, Agrobacterium sp. LC34; identical to SEQ ID NO: 1186
  ref <308>: DATABASE ACCESSION NUMBER: NCBI ACCESSION: NZ_LBHX01000003.1
  ref <309>: DATABASE ENTRY DATE: 2019-04-01
  ref <313>: RELEVANT RESIDUES IN SEQ ID NO: (1)..(1492)

SEQ ID NO: 1210 - DNA, 1492 bp, Agrobacterium sp. LY4; identical to SEQ ID NO: 1184
  ref <308>: DATABASE ACCESSION NUMBER: NCBI ACCESSION: NZ_ASYA01000031.1
  ref <309>: DATABASE ENTRY DATE: 2019-04-01
  ref <313>: RELEVANT RESIDUES IN SEQ ID NO: (1)..(1492)

SEQ ID NO: 1211 - DNA, 1491 bp, Agrobacterium sp. MS2; identical to SEQ ID NO: 1192
  ref <308>: DATABASE ACCESSION NUMBER: NCBI ACCESSION: NZ_QLNF01000016.1
  ref <309>: DATABASE ENTRY DATE: 2019-04-01
  ref <313>: RELEVANT RESIDUES IN SEQ ID NO: (1)..(1491)

SEQ ID NO: 1212 - DNA, 1568 bp, Agrobacterium sp. NCPPB 925
  ref <308>: DATABASE ACCESSION NUMBER: NCBI ACCESSION: NZ_LT009740.1
  ref <309>: DATABASE ENTRY DATE: 2019-04-01
  ref <313>: RELEVANT RESIDUES IN SEQ ID NO: (1)..(1568)
tcaacttgagagtttgatcctggctcagaacgaacgctggcggcaggcttaacacatgcaagtcgaacgcccctccttcaagcaagcttgaaggaattttccttgaaaggaagaagatctaagaatgcttctttaagaagctttcttgatggaggggagtggcagacgggtgagtaacgcgtgggaatctacccatctctgcggaatagctctgggaaactggaattaataccgcatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 1213 - DNA, 1494 bp, Agrobacterium sp. RAC06
  ref <308>: DATABASE ACCESSION NUMBER: NCBI ACCESSION: NZ_CP016499.1
  ref <309>: DATABASE ENTRY DATE: 2019-04-01
  ref <313>: RELEVANT RESIDUES IN SEQ ID NO: (1)..(1494)
tcaacttgagagtttgatcctggctcagaacgaacgctggcggcaggcttaacacatgcaagtcgagcgccccgcaaggggagcggcagacgggtgagtaacgcgtgggaatctaccgtgccctacggaatagctccgggaaactggaattaataccgtatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcagtggagacattgtccttcagttcggctggccctagaacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaacccgcaagggaggcagctaaccacggtagggtcagcgactggggtgaagtcgtaacaaggtagccgtaggggaacctgcggctggatcacctcctttctaagg

SEQ ID NO: 1214 - DNA, 1491 bp, Agrobacterium sp. RS6
  ref <308>: DATABASE ACCESSION NUMBER: NCBI ACCESSION: NZ_RPOB01000020.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaatctaccgtgccctgcggaatagctccgggaaactggaattaataccgcatacgccctacgggggaaagatttatcggggtatgatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 1215 - DNA, 1492 bp, Agrobacterium sp. SUL3; identical to SEQ ID NO: 1186
  ref <308>: DATABASE ACCESSION NUMBER: NCBI ACCESSION: NZ_KQ414501.1
  ref <309>: DATABASE ENTRY DATE: 2019-04-01
  ref <313>: RELEVANT RESIDUES IN SEQ ID NO: (1)..(1492)

SEQ ID NO: 1216 - DNA, 944 bp, Agrobacterium sp. TS43
  ref <308>: DATABASE ACCESSION NUMBER: NCBI ACCESSION: NZ_ASYB01000065.1
  ref <309>: DATABASE ENTRY DATE: 2019-04-01
  ref <313>: RELEVANT RESIDUES IN SEQ ID NO: (1)..(944)
tcaacttgagagtttgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcgggg

SEQ ID NO: 1217 - DNA, 1492 bp, Agrobacterium sp. TS45; identical to SEQ ID NO: 1184
  ref <308>: DATABASE ACCESSION NUMBER: NCBI ACCESSION: NZ_ASYC01000033.1
  ref <309>: DATABASE ENTRY DATE: 2019-04-01
  ref <313>: RELEVANT RESIDUES IN SEQ ID NO: (1)..(1492)

SEQ ID NO: 1218 - DNA, 1492 bp, Agrobacterium sp. UNC420CL41Cvi; identical to SEQ ID NO: 1186
  ref <308>: DATABASE ACCESSION NUMBER: NCBI ACCESSION: NZ_AXUY01000008.1
  ref <309>: DATABASE ENTRY DATE: 2019-04-01
  ref <313>: RELEVANT RESIDUES IN SEQ ID NO: (1)..(1492)

SEQ ID NO: 1219 - DNA, 1492 bp, Agrobacterium sp. YIC 4121; identical to SEQ ID NO: 1184
  ref <308>: DATABASE ACCESSION NUMBER: NCBI ACCESSION: NZ_MRDI01000025.1
  ref <309>: DATABASE ENTRY DATE: 2019-04-01
  ref <313>: RELEVANT RESIDUES IN SEQ ID NO: (1)..(1492)

SEQ ID NO: 1220 - DNA, 1492 bp, Agrobacterium tumefaciens; identical to SEQ ID NO: 1186
  ref <308>: DATABASE ACCESSION NUMBER: NCBI ACCESSION: NZ_LT009758.1
  ref <309>: DATABASE ENTRY DATE: 2019-04-01
  ref <313>: RELEVANT RESIDUES IN SEQ ID NO: (1)..(1492)

SEQ ID NO: 1221 - DNA, 1530 bp, Agrococcus jenensis
  ref <308>: DATABASE ACCESSION NUMBER: NCBI ACCESSION: NZ_RKHJ01000001.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaaggaggagcttgctcctccggattagtggcgaacgggtgagtaatacgtgagcaatgtgcccttgactctgggataagcgctggaaacggcgtctaataccggatacgacgaccggaggcatctcctggtcgtggaaagaacttcggtcaaggatcagctcacggcctatcagctagttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgaaggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcacgtctgctgtgaaaacccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcaaacaggcttagataccctggtagtccatgccgtaaacgttgggaactagatgtggggaccattccacggtctccgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacgagaacgcactggagacagtgaactctttggacactcgtatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgaggtcaaatcatcatgccccttatgtcttgggcttcacgcatgctacaatggccggtacaatgggctgcgataccgcaaggtggagcgaatcccaaaaagccggtctcagttcggattgaggtctgcaactcgacctcatgaagtcggagtcgctagtaatcgtagatcagcaacgctacggtgaatacgttcccgggccttgtacacaccgcccgtcaagtcatgaaagtcggtaacacccgaagccagtggcctaaccttttggagggagctgtcgaaggtgggatcggtgattaggactaagtcgtaacaaggtagccgtaccggaaggtgcggctggatcacctcctttctaagga

SEQ ID NO: 1222 - DNA, 1528 bp, Agrococcus lahaulensis
  ref <308>: DATABASE ACCESSION NUMBER: NCBI ACCESSION: NZ_RBZZ01000134.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacgatgaaggaggagcttgctcctctggattagtggcgaacgggtgagtaatacgtgagcaatgtgcccttgactctgggataagcgctggaaacggcgtctaataccggatacgaccctcggaggcatctcctgatggtggaaagaacttcggtcaaggatcagctcacggcctatcagctagttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgaaggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcaaacaggcttagataccctggtagtccatgccgtaaacgttgggaactagatgtggggaccattccacggtctccgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacggccagagatggtcgccccgcaaggtcggtatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgaggtcaaatcatcatgccccttatgtcttgggcttcacgcatgctacaatggccggtacaatgggctgcgataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccttttggagggagctgtcgaaggtgggatcggtgattaggactaagtcgtaacaaggtagccgtaccggaaggtgcggctggatcacctcctttctaagga

SEQ ID NO: 1223 - DNA, 1445 bp, Agromyces albus
  ref <308>: DATABASE ACCESSION NUMBER: NCBI ACCESSION: NZ_SDPN01000084.1
  ref <309>: DATABASE ENTRY DATE: 2019-04-01
  ref <313>: RELEVANT RESIDUES IN SEQ ID NO: (1)..(1445)
ggattagtggcgaacgggtgagtaacacgtgagtaacctgccctggactctgggataaccccgagaaatcggagctaataccggataggacctggaaccgcatggttttgggtggaaagtttttcggtctgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagggcttcggcttgacggtacctgcagaaaaagcaccggctaactacgtgccagcagccgcggtaatacgtagggtgcgagcgttgtccggaattattgggcgtaaagagctcgtaggcggtttgtcacgtctgctgtgaaatcccgaggctcaacctcgggcctgcagtgggtacgggcagactggagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacataaccgagaacgccgcagaaatgtggaactctttggacactcggttacaggtggtgcatggttgtcgtcagctcgtgtcgtgagatgttgggttaagtcccgcaacgagcgcaaccctcgtcgtatgttgccagcacgtaatggtgggaactcatatgagactgccggggtcaactcggaggaaggtggggatgacgtcaaatcatcatgccccttatgtcttgggcttcacgcatgctacaatggccggtacaaagggttgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccccttgtgggagggagctgtcgaaggtgggatcggtgattaggactaagtcgtaacaaggtagccgtaccggaaggtgcggctggatcacctcctttctaagga

SEQ ID NO: 1224 - DNA, 1525 bp, Agromyces atrinae
  ref <308>: DATABASE ACCESSION NUMBER: NCBI ACCESSION: NZ_SDPM01000016.1
  ref <309>: DATABASE ENTRY DATE: 2019-04-01
  ref <313>: RELEVANT RESIDUES IN SEQ ID NO: (1)..(1525)
tggagagtttgatcctggctcaggacgaacgctggcggcgtgcttaacacatgcaagtcgaacgatgaaggagagcttgctctttggattagtggcgaacgggtgagtaacacgtgagtaacctgccctggactctgggataactgcgggaaactgtagctaataccggatatgaccttggatcgcatgattcttggtggaaagtttttcggtctgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgggggatgacggccttcgggttgtaaacctcttttagtaaggaagaagccttcgggtgacggtacttgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcgtgcagtgggtacgggcagactggagtgcggtaggggagaatggaattcctggtgtagcggtggaatgcgcagatatcaggaggaacaccgatggcgaaggcagttctctgggccgtaactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatgtacgagaacgcctcagaaatgaggaactctttggacactcgtatgcaggtggtgcatggttgtcgtcagctcgtgtcgtgagatgttgggttaagtcccgcaacgagcgcaaccctcgtcgtatgttgccagcacgtaatggtgggaactcatatgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgtaaggagggagctgtcgaaggtgggatcggtgattaggactaagtcgtaacaaggtagccgtaccggaaggtgcggctggatcacctcctttctaagga

SEQ ID NO: 1225 - DNA, 1531 bp, Agromyces binzhouensis
  ref <308>: DATABASE ACCESSION NUMBER: NCBI ACCESSION: NZ_SDPL01000200.1
  ref <309>: DATABASE ENTRY DATE: 2019-04-01
  ref <313>: RELEVANT RESIDUES IN SEQ ID NO: (1)..(1531)
ggagagtttgatcctggctcaggacgaacgctggcggcgtgcttaacacatgcaagtcgaacgatgaagcccagcttgctgggtggattagtggcgaacgggtgagtaacacgtgagtaacctgccctggactctgggataaccccgagaaatcggagctaataccggataggaccttggatcgcatgatttttggtggaaagtttttcggtttgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgcgggatgacggccttcgggttgtaaaccgcttttagtaaggaagaaggggagcttgctccttgacggtacttgcagaaaaaggaccggctaactacgtgccagcagccgcggtaatacgtagggtccgagcgttgtccggaattattgggcgtaaagagctcgtaggcggtttgtcgcgtctgctgtgaaatcccggggctcaactccgggcctgcagtgggtacgggcagacttgagtggtgtaggggagactggaattcctggtgtagcggtggaatgcgcagatatcaggaggaacaccgatggcgaaggcaggtctctgggcacttactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatgaccgagaacgccgcagaaatgtggaactctttggacactcggttacaggtggtgcatggttgtcgtcagctcgtgtcgtgagatgttgggttaagtcccgcaacgagcgcaaccctcgtcgcatgttgccagcacgttatggtggggactcatgtgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggatcggtgattaggactaagtcgtaacaaggtagccgtaccggaaggtgcggctggatcacctcctttctaagga

SEQ ID NO: 1226 - DNA, 1534 bp, Agromyces fucosus
  ref <308>: DATABASE ACCESSION NUMBER: NCBI ACCESSION: NZ_SDPO01000006.1
  ref <309>: DATABASE ENTRY DATE: 2019-04-01
  ref <313>: RELEVANT RESIDUES IN SEQ ID NO: (1)..(1534)
ggagagtttgatcctggctcaggacgaacgctggcggcgtgcttaacacatgcaagtcgaacgatgaacttggagcttgctctgggggattagtggcgaacgggtgagtaacacgtgagtaacctgccctggactctgggataaccccgagaaatcggagctaataccggataggacctggaaccgcatggttttgggtggaaagttttttcggtctgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtaaggaagaaggggagcttgctccttgacggtacttgcagaaaaaggaccggctaactacgtgccagcagccgcggtaatacgtagggtccgagcgttgtccggaattattgggcgtaaagagctcgtaggcggtttgtcacgtctgctgtgaaatcccgaggctcaacctcgggcctgcagtgggtacgggcagactggagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatacgagaacgccgcagaaatgtggaactctttggacactcgtatacaggtggtgcatggttgtcgtcagctcgtgtcgtgagatgttgggttaagtcccgcaacgagcgcaaccctcgtcgtatgttgccagcacgtaatggtgggaactcatatgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggatcggtgattaggactaagtcgtaacaaggtagccgtaccggaaggtgcggctggatcacctcctttctaagga

SEQ ID NO: 1227 - DNA, 1527 bp, Agromyces ramosus
  ref <308>: DATABASE ACCESSION NUMBER: NCBI ACCESSION: NZ_RHHB01000084.1
  ref <309>: DATABASE ENTRY DATE: 2019-04-01
  ref <313>: RELEVANT RESIDUES IN SEQ ID NO: (1)..(1527)
ggagagtttgatcctggctcaggacgaacgctggcggcgtgcttaacacatgcaagtcgaacgatgatccggtgcttgcaccggggattagtggcgaacgggtgagtaacacgtgagtaacctgccctggactctgggataaccccgagaaatcggagctaataccggataggacctcgaatcgcatggtttggggtggaaagtttttcggtctgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagggcttcggcttgacggtacctgcagaaaaaggaccggctaactacgtgccagcagccgcggtaatacgtagggtccgagcgttgtccggaattattgggcgtaaagagctcgtaggcggtttgtcgcgtctgctgtgaaatcccgaggctcaacctcgggcctgcagtgggtacgggcagacttgagtgcggtaggggagaatggaattcctggtgtagcggtggaatgcgcagatatcaggaggaacaccgatggcgaaggcagttctctgggccgtaactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacataaccgagaacgccgcagaaatgtggaactctttggacactcggttacaggtggtgcatggttgtcgtcagctcgtgtcgtgagatgttgggttaagtcccgcaacgagcgcaaccctcgtcgtatgttgccagcacgtaatggtgggaactcatatgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggatcggtgattaggactaagtcgtaacaaggtagccgtaccggaaggtgcggctggatcacctcctttctaagga

SEQ ID NO: 1228 - DNA, 1530 bp, Agromyces sp. FW100M-8
  ref <308>: DATABASE ACCESSION NUMBER: NCBI ACCESSION: NZ_CP035491.1
  ref <309>: DATABASE ENTRY DATE: 2019-04-01
  ref <313>: RELEVANT RESIDUES IN SEQ ID NO: (1)..(1530)
tggagagtttgatcctggctcaggacgaacgctggcggcgtgcttaacacatgcaagtcgaacgatgaactgggagcttgctcctggggattagtggcgaacgggtgagtaacacgtgagtaacctgccctggactctgggataaccccgagaaatcggagctaataccggataggaccttggatcgcatgattcttggtggaaagtttttcggtttgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgcgggatgacggccttcgggttgtaaaccgcttttagtaaggaagaagccctttggggtgacggtacttgcagaaaaaggaccggctaactacgtgccagcagccgcggtaatacgtagggtccgagcgttgtccggaattattgggcgtaaagagctcgtaggcggtttgtcgcgtctgctgtgaaatctagaggctcaacctctagcctgcagtgggtacgggcagacttgagtggtgtaggggagactggaattcctggtgtagcggtggaatgcgcagatatcaggaggaacaccgatggcgaaggcaggtctctgggcacttactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatgaccgagaacgggccagaaatggtcaactctttggacactcggttacaggtggtgcatggttgtcgtcagctcgtgtcgtgagatgttgggttaagtcccgcaacgagcgcaaccctcgtcgcatgttgccagcacgttatggtggggactcatgtgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggatcggtgattaggactaagtcgtaacaaggtagccgtaccggaaggtgcggctggatcacctcctttctaagga

SEQ ID NO: 1229 - DNA, 1526 bp, Agromyces sp. LHK192
  ref <308>: DATABASE ACCESSION NUMBER: NCBI ACCESSION: NZ_CP034753.1
  ref <309>: DATABASE ENTRY DATE: 2019-04-01
  ref <313>: RELEVANT RESIDUES IN SEQ ID NO: (1)..(1526)
tggagagtttgatcctggctcaggacgaacgctggcggcgtgcttaacacatgcaagtcgaacgatgatccaggagcttgcttctggggattagtggcgaacgggtgagtaacacgtgagtaacctgccctggactctgggataacccgagaaatcggagctaataccggataggaccctgtaccgcatggtgtggggtggaaagttttttcggtctgggatggactcgcggcctatcagcttgttggtgaggtaacggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgcgggatgacggccttcgggttgtaaaccgcttttagtagggaagaagggcttcggcttgacggtacctgcagaaaaaggaccggctaactacgtgccagcagccgcggtaatacgtagggtccgagcgttgtccggaattattgggcgtaaagagctcgtaggcggtttgtcgcgtctgctgtgaaaactagaggctcaacctctagcctgcagtgggtacgggcagacttgagtgcggtaggggagaatggaattcctggtgtagcggtggaatgcgcagatatcaggaggaacaccgatggcgaaggcagttctctgggccgtaactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacacgagaacgggccagaaatggtcaactctttggacactcgtgaacaggtggtgcatggttgtcgtcagctcgtgtcgtgagatgttgggttaagtcccgcaacgagcgcaaccctcgtcgcatgttgccagcacgtaatggtggggactcatgtgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggatcggtgattaggactaagtcgtaacaaggtagccgtaccggaaggtgcggctggatcacctcctttcta

SEQ ID NO: 1230 - DNA, 1532 bp, Agromyces sp. OV415
  ref <308>: DATABASE ACCESSION NUMBER: NCBI ACCESSION: NZ_RBXQ01000012.1
  ref <309>: DATABASE ENTRY DATE: 2019-04-01
  ref <313>: RELEVANT RESIDUES IN SEQ ID NO: (1)..(1532)
tggagagtttgatcctggctcaggacgaacgctggcggcgtgcttaacacatgcaagtcgaacgatgaaggggagcttgctccttggattagtggcgaacgggtgagtaacacgtgagtaacctgccctggactctgggataaccccgagaaatcggagctaataccggatatgacttctcatcgcatggtggggggtggaaagtttttcggtctgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgcgggatgacggccttcgggttgtaaaccgcttttagtaaggaagaaggggagcttgctccttgacggtacttgcagaaaaaggaccggctaactacgtgccagcagccgcggtaatacgtagggtccgagcgttgtccggaattattgggcgtaaagagctcgtaggcggtttgtcgcgtctgctgtgaaaactagaggctcaacctctagcctgcagtgggtacgggcagacttgagtggtgtaggggagactggaattcctggtgtagcggtggaatgcgcagatatcaggaggaacaccgatggcgaaggcaggtctctgggcacttactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatgaccgagaacgctgcagaaatgtggaactctttggacactcggttacaggtggtgcatggttgtcgtcagctcgtgtcgtgagatgttgggttaagtcccgcaacgagcgcaaccctcgtcgcatgttgccagcacgttatggtggggactcatgtgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggatcggtgattaggactaagtcgtaacaaggtagccgtaccggaaggtgcggctggatcacctcctttctaagga

SEQ ID NO: 1231 - DNA, 1529 bp, Agromyces sp. OV429
  ref <308>: DATABASE ACCESSION NUMBER: NCBI ACCESSION: NZ_QTTL01000007.1
  ref <309>: DATABASE ENTRY DATE: 2019-04-01
  ref <313>: RELEVANT RESIDUES IN SEQ ID NO: (1)..(1529)
tggagagtttgatcctggctcaggacgaacgctggcggcgtgcttaacacatgcaagtcgaacgatgaactccagcttgctggggggattagtggcgaacgggtgagtaacacgtgagtaacctgccctggactctgggataagcgttggaaacgacgtctaataccggataggacctctgaccgcatggtcgggggtggaaagttttttcggtctgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgcgggatgacggccttcgggttgtaaaccgcttttagtagggaagaagggcttcggcttgacggtacctgcagaaaaaggaccggctaactacgtgccagcagccgcggtaatacgtagggtccgagcgttgtccggaattattgggcgtaaagagctcgtaggcggtttgtcgcgtctgctgtgaaaactggaggctcaacctccagcctgcagtgggtacgggcagactagagtgcggtaggggagaatggaattcctggtgtagcggtggaatgcgcagatatcaggaggaacaccgatggcgaaggcagttctctgggccgtaactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatgaccgagaacgccctagaaatagggaactctttggacactcggttacaggtggtgcatggttgtcgtcagctcgtgtcgtgagatgttgggttaagtcccgcaacgagcgcaaccctcgtcgcatgttgccagcacgtaatggtgggaactcatgtgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggatcggtgattaggactaagtcgtaacaaggtagccgtaccggaaggtgcggctggatcacctcctttctaagga

SEQ ID NO: 1232 - DNA, 1535 bp, Agromyces sp. OV568
  ref <308>: DATABASE ACCESSION NUMBER: NCBI ACCESSION: NZ_QUNT01000006.1
  ref <309>: DATABASE ENTRY DATE: 2019-04-01
  ref <313>: RELEVANT RESIDUES IN SEQ ID NO: (1)..(1535)
tggagagtttgatcctggctcaggacgaacgctggcggcgtgcttaacacatgcaagtcgaacgatgaacttggagcttgctctgggggattagtggcgaacgggtgagtaacacgtgagtaacctgccctggactctgggataaccccgagaaatcggagctaataccggataggacctggaaccgcatggttttgggtggaaagttttttcggtctgggatggactcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtaaggaagaaggggagcttgctccttgacggtacttgcagaaaaaggaccggctaactacgtgccagcagccgcggtaatacgtagggtccgagcgttgtccggaattattgggcgtaaagagctcgtaggcggtttgtcacgtctgctgtgaaatcccgaggctcaacctcgggcctgcagtgggtacgggcagactggagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatacgagaacgccgcagaaatgtggaactctttggacactcgtatacaggtggtgcatggttgtcgtcagctcgtgtcgtgagatgttgggttaagtcccgcaacgagcgcaaccctcgtcgtatgttgccagcacgtaatggtgggaactcatatgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggatcggtgattaggactaagtcgtaacaaggtagccgtaccggaaggtgcggctggatcacctcctttctaagga

SEQ ID NO: 1233 - DNA, 1491 bp, Ahrensia kielensis
  ref <308>: DATABASE ACCESSION NUMBER: NCBI ACCESSION: NZ_KB894530.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcaggcttaacacatgcaagtcgaacggtctcttcggaggcagtggcagacgggtgagtaacgcgtgggaatatacctatcagtacggaacaacagttggaaacgactgctaataccgtatacgcccttcgggggaaagatttattgctgatagattagcccgcgttagattagctagttggtggggtaaaggcctaccaaggcgacgatctatagctggtctgagaggatgatcagccacactgggactgagacacggcccagactcctacgggaggcagcagtggggaatattggacaatgggcgaaagcctgatccagccatgccgcgtgtgtgatgaaggccttagggttgtaaagcactttcaacggtgaagataatgacggtaaccgtagaagaagccccggctaacttcgtgccagcagccgcggtaatacgaagggggctagcgttgttcggaattactgggcgtaaagcgcacgtaggcggattgatcagttagaggtgaaatcccagggctcaaccctggaactgcctttaatactgtcagtctagagatcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatggaagctagccgtcgggcagtatactgttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacataccgatcgcggtatctggagacagatactttcagttaggctggatcggatacaggtgctgcatggctgtcgtcagctcgtgtcgtgagatgttgggttaagtcccgcaacgagcgcaaccctcgcctttagttgccagcattaagttgggcactctagagggactgccggtgataagccggaggaaggtggggatgacgtcaagtcctcatggcccttacgggctgggctacacacgtgctacaatggtggtgacagtgggcagcgagacggcaacgtcgagctaatctccaaaaaccatctcagttcggattggggtctgcaactcgaccccatgaagttggaatcgctagtaatcgtggatcagcatgccacggtgaatacgttcccgggccttgtacacaccgcccgtcacaccatgggagttggttctacccgaaggtgctgtgctaaccgcaaggaggcaggcaaccacggtagggtcagcgactggggtgaagtcgtaacaaggtagccgtaggggaacctgcggctggatcacctcctttctaagg

SEQ ID NO: 1234 - DNA, 1496 bp, Ahrensia marina
  ref <308>: DATABASE ACCESSION NUMBER: NCBI ACCESSION: NZ_JXMU01000021.1
  ref <309>: DATABASE ENTRY DATE: 2019-04-01
  ref <313>: RELEVANT RESIDUES IN SEQ ID NO: (1)..(1496)
aacttgagagtttgatcctggctcagaacgaacgctggcggcaggcttaacacatgcaagtcgaacgctcacttcggtgagagtggcagacgggtgagtaacgcgtgggaatatacctatcagtacggaacaacagttggaaacgactgctaataccgtatacgcccttcgggggaaagatttattgctgatagattagcccgcgttagattagctagatggtggggtaaaggcctaccatggcgacgatctatagctggtctgagaggatgatcagccacactgggactgagacacggcccagactcctacgggaggcagcagtggggaatattggacaatgggcgaaagcctgatccagccatgccgcgtgtgtgatgaaggccttagggttgtaaagcactttcaacggtgaagataatgacggtaaccgtagaagaagccccggctaacttcgtgccagcagccgcggtaatacgaagggggctagcgttgttcggaattactgggcgtaaagcgcacgtaggcggattgatcagttagaggtgaaatcccggggctcaaccccggaactgcctttaatactgtcagtctagagatcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatggaagctagccgtcgggcagtatactgttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccgatcgcggttaccagagatggtatccttcagttaggctggatcggtgacaggtgctgcatggctgtcgtcagctcgtgtcgtgagatgttgggttaagtcccgcaacgagcgcaaccctcgcctttagttgccagcattaagttgggcactctagagggactgccggtgataagccggaggaaggtggggatgacgtcaagtcctcatggcccttacgggctgggctacacacgtgctacaatggtggtgacagtgggcagcgagaccgcgaggtcgagctaatctccaaaaaccatctcagttcggatcgcactctgcaactcgagtgcgtgaagttggaatcgctagtaatcgtggatcagcatgccacggtgaatacgttcccgggccttgtacacaccgcccgtcacaccatgggagttggttctacccgaaggtgctgtgctaaccgcaaggaggcaggcaaccacggtagggtcagcgactggggtgaagtcgtaacaaggtagccgtaggggaacctgcggctggatcacctcctttctaaggaaatt

SEQ ID NO: 1235 - DNA, 1491 bp, Ahrensia sp. 13 GOM-1096m
  ref <308>: DATABASE ACCESSION NUMBER: NCBI ACCESSION: NZ_JIAX01000002.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcaggcttaacacatgcaagtcgaacggtctcttcggaggcagtggcagacgggtgagtaacgcgtgggaatatacctatcagtacggaacaacagttggaaacgactgctaataccgtatacgccctttgggggaaagatttattgctgatagattagcccgcgttagattagctagttggtggggtaaaggcctaccaaggcgacgatctatagctggtctgagaggatgatcagccacactgggactgagacacggcccagactcctacgggaggcagcagtggggaatattggacaatgggcgaaagcctgatccagccatgccgcgtgtgtgatgaaggccttagggttgtaaagcactttcaacggtgaagataatgacggtaaccgtagaagaagccccggctaacttcgtgccagcagccgcggtaatacgaagggggctagcgttgttcggaattactgggcgtaaagcgcacgtaggcggattgatcagttagaggtgaaatcccagggctcaaccctggaactgcctttaatactgtcagtctagagatcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatggaagctagccgtcgggcagtatactgttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacataccgatcgcggtatctggagacagataccttcagttaggctggatcggatacaggtgctgcatggctgtcgtcagctcgtgtcgtgagatgttgggttaagtcccgcaacgagcgcaaccctcgcctttagttgccagcattaagttgggcactctagagggactgccggtgataagccggaggaaggtggggatgacgtcaagtcctcatggcccttacgggctgggctacacacgtgctacaatggtggtgacagtgggcagcgagacggcaacgtcgagctaatctccaaaaaccatctcagttcggattggggtctgcaactcgaccccatgaagttggaatcgctagtaatcgtggatcagcatgccacggtgaatacgttcccgggccttgtacacaccgcccgtcacaccatgggagttggttctacccgaaggtgctgtgctaaccgcaaggaggcaggcaaccacggtagggtcagcgactggggtgaagtcgtaacaaggtagccgtaggggaacctgcggctggatcacctcctttctaagg

SEQ ID NO: 1236 - DNA, 1491 bp, Ahrensia sp. R2A130
  ref <308>: DATABASE ACCESSION NUMBER: NCBI ACCESSION: NZ_AEEB01000022.1
  ref <309>: DATABASE ENTRY DATE: 2019-04-01
  ref <313>: RELEVANT RESIDUES IN SEQ ID NO: (1)..(1491)
aacctgagagtttgatcctggctcagaacgaacgctggcggcaggcttaacacatgcaagtcgaacgctcacttcggtgagagtggcagacgggtgagtaacacgtgggaatctacctatctctgcggaacaacacatagaaatgtgtgctaataccgcatacgccctccgggggaaagatttatcggagatagatgagcccgcgcttgattagctagttggtgaggtaatggctcaccaaggcgacgatcaatagctggtctgagaggatgatcagccacactggaactgagacacggtccagactcctacgggaggcagcagtggggaatattggacaatgggggcaaccctgatccagccatgccgcgtgagtgatgaaggccctagggttgtaaagctctttcgcaggtgaagataatgacggtaacctgtaaagaagccccggctaacttcgtgccagcagccgcggtaatacgaagggggctagcgttgttcggaataactgggcgtaaagcgtacgtaggcggattggaaagttagaggtgaaatccctgggctcaacccaggaactgcctttaaaactatcagtctagaggtcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatggaagccagctgtcaggatgtatacatcttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacataccgatcgcggatttcagagatgatttccttcagttaggctggatcggatacaggtgctgcatggctgtcgtcagctcgtgtcgtgagatgttgggttaagtcccgcaacgagcgcaaccctcgcctttagttgccagcattaagttgggcactctagagggactgccggtgataagccggaggaaggtggggatgacgtcaagtcctcatggcccttacgggctgggctacacacgtgctacaatggtggtgacagtgggcagcgagatcgcaaggtcgagctaatctccaaaaaccatctcagttcggattgttctctgcaactcgagagcatgaagttggaatcgctagtaatcgtggatcagcatgccacggtgaatacgttcccgggccttgtacacaccgcccgtcacaccatgggagttggttctacccgaaggcgctgcgctaaccgcaaggaggcaggcgaccacggtagggtcagcgactggggtgaagtcgtaacaaggtagccctaggggaacctggggctggatcacctcctttctaagg

SEQ ID NO: 1237 - DNA, 1516 bp, Akkermansia sp. aa 0143
  ref <308>: DATABASE ACCESSION NUMBER: NCBI ACCESSION: NZ_RCXD01000025.1
  ref <309>: DATABASE ENTRY DATE: 2019-04-01
  ref <313>: RELEVANT RESIDUES IN SEQ ID NO: (1)..(1516)
atggagagtttgattctggctcagaacgaacgctggcggcgtggataagacatgcaagtcgaacgggagaattgctagcttgctaataattctctagtggcgcacgggtgagtaacacgtgagtaacctgcctcttagtgggggatagccctgggaaaccgggattaataccgcatacgattgaaagatcaaagcagcaatgcgctaggagatgggctcgcggcctattagttagttggtgaggtaacggctcaccaaggcgatgacgggtagccggtctgagaggatgtccggccacactggaactgagacacggtccagacacctacgggtggcagcagtcgagaatcattcacaatgggggcaaccctgatggtgcgacgccgcgtgggggaatgaaggtcttcggattgtaaacccctgtcatgtgggagcaaattaaaaagatagtaccacaagaggaagagacggctaactctgtgccagcagccgcggtaatacagaggtctcaagcgttgttcggaatcactgggcgtaaagcgtgcgtaggctgtttcgtaagtcgtgtgtgaaaggcaggggctcaacccctggattgcacatgatactgcgagactagagtaatggagggggaaccggaattctcggtgtagcagtgaaatgcgtagatatcgagaggaacactcgtggcgaaggcgggttcctggacattaactgacgctgaggcacgaaggccaggggagcgaaagggattagatacccctgtagtcctggcagtaaacggtgcacgcttggtgtgcggggaatcgaccccctgcgtgccggagctaacgcgttaagcgtgccgcctggggagtacggtcgcaagattaaaactcaaagaaattgacggggacccgcacaagcggtggagtatgtggcttaattcgatgcaacgcgaagaaccttacctgggcttgacatgtaatgaacaacatgtgaaagcatgcgactcttcggaggcgttacacaggtgctgcatggccgtcgtcagctcgtgtcgtgagatgtttggttaagtccagcaacgagcgcaacccctgttgccagttaccagcacgtcaaggtggggactctggcgagactgcccagatcaactgggaggaaggtggggacgacgtcaggtcagtatggcccttatgcccagggctgcacacgtactacaatgcccagtacagagggggccgaagccgcgaggcggaggaaatcctgaaaactgggcccagttcggactgtaggctgcaacccgcctacacgaagccggaatcgctagtaatggcgcatcagctacggcgccgtgaatacgttcccgggtcttgtacacaccgcccgtcacatcatggaagccggtcgcacccgaagtatctgaagccaaccgcaaggaggcagggtcctaaggtgagactggtaactgggatgaagtcgtaacaaggtagccgtaggggaacctgcggctggatcacctcctttctatgga

SEQ ID NO: 1238 - DNA, 1472 bp, Albidovulum inexpectatum
  ref <308>: DATABASE ACCESSION NUMBER: NCBI ACCESSION: NZ_PRDS01000020.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgaggacttcggtcctagcggcggacgggtgagtaacgcgtgggaacgtgcccagaggtacgggatagcccagggaaacttggagtaataccgtatgagccctacgggggaaagattttatcgcctttggatcggcccgcgttggattaggtagttggtggggtaatggcctaccaagccgacgatccatagctggtttgagaggatgatcagccacactgggactgagacacggcccagactcctacgggaggcagcagtggggaatcttggacaatgggggaaaccctgatccagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactggaaagttgggggtgaaatcccggggctcaacctcggaactgccttcaaaactcccagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcgcacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggggtcgcgggcccagagatgggcctttcagttcggctggaccccacacaggtgctgcatggctgtcgtcagctcgtgtcgtgagatgttcggttaagtccggcaacgagcgcaacccacacccttagttgccagcgcctcgggcgggcactctaggggaactgccgatgataagtcggaggaaggtgtggatgacgtcaagtcctcatggcccttacgggttgggctacacacgtgctacaatggcagtgacaatgggttaatccccaaaagctgtctcagttcggattgtcctctgcaactcgagggcatgaagtcggaatcgctagtaatcgcgtaacagcatgacgcggtgaatacgttcccgggccttgtacacaccgcccgtcacaccatgggagttgggttcacccgaagacggtgcgccaacctcgcaagaggaggcagccggccacggtgggctcagcgactggggtgaagtcgtaacaaggtagccgtaggggaacctgcggctggatcacctcctttcta

SEQ ID NO: 1239 - DNA, 1468 bp, Albimonas donghaensis
  ref <308>: DATABASE ACCESSION NUMBER: NCBI ACCESSION: NZ_FNMZ01000020.1
  ref <309>: DATABASE ENTRY DATE: 2019-04-01
  ref <313>: RELEVANT RESIDUES IN SEQ ID NO: (1)..(1468)
caacctgagagtttgatcctggctcagaacgaacgctggcggcaggcttaacacatgcaagtcgcgcgaagtcttcggacttagcggcggacgggtgagtaacgcgtgggaacgtgcccttcagtgcggaacagccccgggaaactgggattaataccgcatacgcccttcgggggaaagatttatcgctgagggatcggcccgcgtctgattagatagttggtggggtaatggcctaccaagtctacgatcagtagctggtctgagaggatgaccagccacactgggactgagacacggcccagactcctacgggaggcagcagtggggaatcttggacaatgggcgcaagcctgatccagccatgccgcgtgaacgatgaaggccttagggttgtaaagttctttcgctggtgacgataatgacggtaaccagagaagaagccccggctaactccgtgccagcagccgcggtaatacggagggggctagcgttgttcggaattactgggcgtaaagcgcacgtaggcggattggaaagttgggggtgaaatcccagggctcaaccctggaactgcctccaaaactcccagtctagagatcgagagaggcgggtggaattccgagtgtagaggtgaaattcgtagatattcggaggaacaccagtggcgaaggcggcccgctggctcgatactgacgctgaggtgcgaaagcgtggggagcaaacaggattagataccctggtagtccacgccgtaaacgatgaatgctagtcgtcgggttgcatgcaattcggtgacgcacctaacggattaagcattccgcctggggagtacggtcgcaagattaaaactcaaaggaattgacgggggcccgcacaagcagtggagcatgtggtttaattcgaagcaacgcgcagaaccttaccaccttttgacatgggtatcgcggtcttccgagaggaagtccttcagttcggctggataccacacaggtgctgcatggctgtcgtcagctcgtgtcgtgagatgttgggttaagtcccgcaacgagcgcaaccctcgcccttagttgccagcattcagttgggcactctaggggaaccgccggtgacaagccggaggaaggcggggacgacgtcaagtcctcatggcccttacaaggtgggctacacacgtgctacaatggcagtgacaatgggttaatccccaaaaactgtctcagttcggattggggtctgcaactcgaccccatgaagtcggaattgctagtaatcgcgtaacagcatgacgcggtgaatacgttcccgggccttgtacacaccgcccgtcacaccatgggagttggatctacccgaaggccgtgcgccaaccgcaaggaggcagcggaccacggtaggttcagcgactggggtgaagtcgtaacaaggtagccgtaggggaacctgcggctggatcacctcctttcta

SEQ ID NO: 1240 - DNA, 1469 bp, Albimonas pacifica
  ref <308>: DATABASE ACCESSION NUMBER: NCBI ACCESSION: NZ_FOQH01000033.1
  ref <309>: DATABASE ENTRY DATE: 2019-04-01
  ref <313>: RELEVANT RESIDUES IN SEQ ID NO: (1)..(1469)
caacctgagagtttgatcctggctcagaacgaacgctggcggcaggcttaacacatgcaagtcgcgcgaaccttcgggttagcggcggacgggtgagtaacgcgtgggaacgtgccctttggttcggaatagccccgggaaactgggattaataccggatacgcccttcgggggaaagatttatcgccaagggatcggcccgcgtctgattagatagttggtggggtaatggcctaccaagtctacgatcagtagctggtctgagaggatgaccagccacactgggactgagacacggcccagactcctacgggaggcagcagtggggaatcttggacaatgggcgcaagcctgatccagccatgccgcgtgaacgatgaaggccttagggttgtaaagttctttcgccggtgacgataatgacggtaaccggagaagaagccccggctaactccgtgccagcagccgcggtaatacggagggggctagcgttgttcggaattactgggcgtaaagcgcacgtaggcggaccattaagtcgggggtgaaatcccggggctcaaccccggaactgccttcgatactggtggtctggaggtcgagagaggcgagtggaattccgagtgtagaggtgaaattcgtagatattcggaggaacaccagtggcgaaggcggctcgctggctcgatactgacgctgaggtgcgaaagcgtggggagcaaacaggattagataccctggtagtccacgccgtaaacgatgaatgctagacgtcgggcagcatgctgttcggtgtcgcagccaacgcattaagcattccgcctggggagtacggtcgcaagattaaaactcaaaggaattgacgggggcccgcacaagcggtggagcatgtggtttaattcgaagcaacgcgcagaaccttaccaccttttgacatgcctctcgcgggccggggagacccggtccttcagttcggctggagagtgcacaggtgctgcatggctgtcgtcagctcgtgtcgtgagatgttgggttaagtcccgcaacgagcgcaaccctcgcctttagttgccatcagttcggctgggcactctaaaggaaccgccggtgacaagccggaggaaggcggggacgacgtcaagtcctcatggcccttacaaggtgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggccgtgcgccgaccctcacggggggcagcggaccacggtaggttcagcgactggggtgaagtcgtaacaaggtagccgtaggggaacctgcggctggatcacctcctttcta

SEQ ID NO: 1241 - DNA, 1544 bp, Alcaligenes aquatilis
  ref <308>: DATABASE ACCESSION NUMBER: NCBI ACCESSION: NZ_CP032153.1
  ref <309>: DATABASE ENTRY DATE: 2019-04-01
  ref <313>: RELEVANT RESIDUES IN SEQ ID NO: (1)..(1544)
agattaaactgaagagtttgatcctggctcagattgaacgctagcgggatgctttacacatgcaagtcgaacggcagcacgagagagcttgctctcttggtggcgagtggcggacgggtgagtaatatatcggaacgtgcccagtagcgggggataactactcgaaagagtggctaataccgcatacgccctacgggggaaagggggggattcttcggaacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtatctcctaatacgagatactgctgacggtatctgcagaataagcaccggctaactacgtgccagcagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaggggggtagaattccacgtgtagcagtgaaatgcgtagatatgtggaggaataccgatggcgaaggcagccccctgggataatactgacgctcagacacgaaagcgtggggagcaaacaggattagataccctggtagtccacgccctaaacgatgtcaactagctgttggggccgttaggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcgggacagagggtcgccaacccgcgagggggagccaatctcagaaacccgatcgtagtccggatcgcagtctgcaactcgactgcgtgaagtcggaatcgctagtaatcgcggatcagaatgtcgcggtgaatacgttcccgggtcttgtacacaccgcccgtcacaccatgggagtgggtttcaccagaagtaggtagcctaaccgtaaggagggcgcttaccacggtgggattcatgactggggtgaagtcgtaacaaggtagccgtatcggaaggtgcggctggatcacctccttt

SEQ ID NO: 1242 - DNA, 1542 bp, Alcaligenes faecalis
  ref <308>: DATABASE ACCESSION NUMBER: NCBI ACCESSION: NZ_UFSQ01000005.1
  ref <309>: DATABASE ENTRY DATE: 2019-04-01
  ref <313>: RELEVANT RESIDUES IN SEQ ID NO: (1)..(1542)
agattaaactgaagagtttgatcctggctcagattgaacgctagcgggatgctttacacatgcaagtcgaacggcagcgcgagagagcttgctctcttggcggcgagtggcggacgggtgagtaatatatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtatcccctaatacgggatactgctgacggtatctgcagaataagcaccggctaactacgtgccagcagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaggggggtagaattccacgtgtagcagtgaaatgcgtagatatgtggaggaataccgatggcgaaggcagccccctgggataatactgacgctcagacacgaaagcgtggggagcaaacaggattagataccctggtagtccacgccctaaacgatgtcaactagctgttggggccgttaggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaagccgaagagatttggccgtgctcgcaagagaaccggaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcgggacagagggtcgccaacccgcgagggggagccaatctcagaaacccgatcgtagtccggatcgcagtctgcaactcgactgcgtgaagtcggaatcgctagtaatcgcggatcagaatgtcgcggtgaatacgttcccgggtcttgtacacaccgcccgtcacaccatgggagtgggtttcaccagaagtaggtagcctaaccgcaaggagggcgcttaccacggtgggattcatgactggggtgaagtcgtaacaaggtagccgtatcggaaggtgcggctggatcacctccttt

SEQ ID NO: 1243 - DNA, 1544 bp, Alcaligenes sp. 393; identical to SEQ ID NO: 1241
  ref <308>: DATABASE ACCESSION NUMBER: NCBI ACCESSION: NZ_RHXD01000027.1
  ref <309>: DATABASE ENTRY DATE: 2019-04-01
  ref <313>: RELEVANT RESIDUES IN SEQ ID NO: (1)..(1544)

SEQ ID NO: 1244 - DNA, 1476 bp, Alcaligenes sp. HPC1271
  ref <308>: DATABASE ACCESSION NUMBER: NCBI ACCESSION: NZ_AMXV01000004.1
  ref <309>: DATABASE ENTRY DATE: 2019-04-01
  ref <313>: RELEVANT RESIDUES IN SEQ ID NO: (1)..(1476)
agattaaactgaagagtttgatcctggctcagattgaacgctagcgggatgctttacacatgcaagtcgaacggcagcgcgagagagcttgctctcttggcggcgagtggcggacgggtgagtaatatatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtatcccctaatacgggatactgctgacggtatctgcagaataagcaccggctaactacgtgccagcagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaggggggtagaattccacgtgtagcagtgaaatgcgtagatatgtggaggaataccgatggcgaaggcagccccctgggataatactgacgctcagacacgaaagcgtggggagcaaacaggattagataccctggtagtccacgccctaaacgatgtcaactagctgttggggccgttaggctttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaagccgaagagatttggccgtgctcgcaagagaaccggaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcgggacagagggtcgccaacccgcgagggggagccaatctcagaaacccgatcgtagtccggatcgcagtctgcaactcgactgcgtgaagtcggaatcgctagtaatcgcggatcagaatgtcgcggtgaatacgttcccgggtcttgtacacaccgcccgtcacaccatgggagtgggtttcaccagaagtaggtagcctaaccgcaaggagggcgcttaccacggtggga

SEQ ID NO: 1245 - DNA, 1548 bp, Alcaligenes sp. RS4
  ref <308>: DATABASE ACCESSION NUMBER: NCBI ACCESSION: NZ_RQSO01000014.1
  ref <309>: DATABASE ENTRY DATE: 2019-04-01
  ref <313>: RELEVANT RESIDUES IN SEQ ID NO: (1)..(1548)
agattaaactgaagagtttgatcctggctcagattgaacgctagcgggatgccttacacatgcaagtcgaacggcagcgggaaagtagcttgctacttttgccggcgagtggcgaacgggtgagtaatgtatcggaacgtgcccagtagcgggggataactacgcgaaagcgtggctaataccgcatacgccctacgggggaaagggggggatcttaggacctctcactattggagcggccgatatcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttgtcagggaagaaaaggtttcggataatacccggaactgatgacggtacctgaagaataagcaccggctaactacgtgccagcagccgcggtaatacgtagggtgcaagcgttaatcggaattactgggcgtaaagcgtgcgcaggcggttcggaaagaaagatgtgaaatcccagggctcaaccttggaactgcatttttaactaccgaactagagtatgtcagaggggggtggaattccacgtgtagcagtgaaatgcgtagatatgtggaggaacaccgatggcgaaggcagccccctgggataatactgacgctcatgcacgaaagcgtggggagcaaacaggattagataccctggtagtccacgccctaaacgatgtcaactagctgttgggcccttcggggcttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgcaagagaaccggaacacaggtgctgcatggctgtcgtcagctcgtgtcgtgagatgttgggttaagtcccgcaacgagcgcaacccttgtcattagttgctacatttagttgagcactctaatgagactgccggtgacaaaccggaggaaggtggggatgacgtcaagtcctcatggcccttatgggtagggcttcacacgtcatacaatggtcgggacagagggttgccaaaccgcaaggtggagctaatctcataaacccgatcgtagtccggattgcaggctgcaactcgcctgcatgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctccttt

SEQ ID NO: 1246 - DNA, 1541 bp, Alcanivorax indicus
  ref <308>: DATABASE ACCESSION NUMBER: NCBI ACCESSION: NZ_QGMP01000008.1
  ref <309>: DATABASE ENTRY DATE: 2019-04-01
  ref <313>: RELEVANT RESIDUES IN SEQ ID NO: (1)..(1541)
taactgaagagtttgatcatggctcagattgaacgctggcggcaggcctaacacatgcaagtcgagcggcagcgggagtagcttgctacttgccggcgagcggcggacgggtgagtaacgcgtgggaatctacccattggtgggggataacctggggaaacccaggctaataccgcatacgccctacgggggaaagcaggggatcttcggaccttgcgctgatggatgagcccgcgtcggattagcttgttggtgaggtaaaggctcaccaaggcgacgatccgtagctggtctgagaggatggccagccacatcgggactgagacacggcccgaactcctacgggaggcagcagtggggaatcttggacaatgggggcaaccctgatccagccatgccgcgtgtgtgaagaaggccctagggttgtaaagcactttcagcagggaggaaggcttcgggttaataccctggagtacttgacgttacctgcagaagaagcaccggctaatttcgtgccagcagccgcggtaatacgaaaggtgcgagcgttaatcggaattactgggcgtaaagcgcgcgtaggcggttagttaagtctgatgtgaaagcccagggctcaaccttggaactgcatcggatactggctagctagagtgcagtagagggaggtggaatttccggtgtagcggtgaaatgcgtagagatcggaaggaacaccagtggcgaaggcggcctcctggactgacactgacgctgaggtgcgaaagcgtggggagcaaacaggattagataccctggtagtccacgccgtaaacgatgtctactagccgttggaggtcttgtatctttagtggcgcagctaacgcgataagtagaccgcctggggagtacggccgcaaggttaaaactcaaatgaattgacgggggcccgcacaagcggtggagcatgtggtttaattcgatgcaacgcgaagaaccttacctactcttgacatcctcggaacttggcagagatgccttggtgccttcgggagccgagtgacaggtgctgcatggctgtcgtcagctcgtgtcgtgagatgttgggttaagtcccgtaacgagcgcaacccttgtccttagttgccagcgattcggtcgggaactctaaggagactgccggtgacaaaccggaggaaggtggggacgacgtcaagtcatcatggcccttacgagtagggctacacacgtgctacaatggccggtacagagggcagcgataccgcgaggtggagcaaatctcttaaaaccggtcgtagtccggattgcagtctgcaactcgactgcatgaagtcggaatcgctagtaatcgcggatcagaatgccgcggtgaatacgttcccgggccttgtacacaccgcccgtcacaccatgggagtggattgcaccagaagtagttagtctaaccttcgggaggacgattaccacggtgtggttcatgactggggtgaagtcgtaacaaggtagccgtaggggaacctgcggctggatcacctccttaa

SEQ ID NO: 1247 - DNA, 1543 bp, Alcanivorax sp. CP2C
  ref <308>: DATABASE ACCESSION NUMBER: NCBI ACCESSION: NZ_LXTS02000037.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcttaacacatgcaagtcgagcggtaacagggggtgcttgcaccccgctgacgagcggcggacgggtgagtaatgcataggaaactgcccagtagtgggggatagcccggggaaacccggattaataccgcgtacgcccttcgggggaaagcaggggatcttcggaccttgcgctattggatgtgcctatgtcggattagctagttggtggggtaaaggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaaactctgcgactaatactcgtagggcttgacgttactcacagaagaagcaccggctaactccgtgccagcagccgcggtaatacggagggtgcaagcgttaatcggaattactgggcgtaaagcgcgcgtaggtggtttgataagcgagatgtgaaagccccgggcttaacctgggaacggcatttcgaactgtcaggctagagtatggtagagggtagtggaatttcctgtgtagcggtgaaatgcgtagatataggaaggaacaccagtggcgaaggcggctacctggaccaatactgacactgaggtgcgaaagcgtggggagcaaacaggattagataccctggtagtccacgccgtaaacgatgtctactagccgttgggactcttgaagtcttagtggcgcagctaacgcactaagtagaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccctagttgctagcagttcggctgagaactctagggagactgccggtgacaaaccggaggaaggtggggatgacgtcaggtcatcatggcccttacggccagggctacacacgtgctacaatggtgcgcacagagggctgcaaacccgcgagggggagccaatctcacaaaacgcatcgtagtccggatcgcagtctgcaactcgactgcgtgaagtcggaatcgctagtaatcgtgaatcagaatgtcacggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaac

SEQ ID NO: 1248 - DNA, 1542 bp, Alcanivorax sp. EA2
  ref <308>: DATABASE ACCESSION NUMBER: NCBI ACCESSION: NZ_QREA01000016.1
  ref <309>: DATABASE ENTRY DATE: 2019-04-01
  ref <313>: RELEVANT RESIDUES IN SEQ ID NO: (1)..(1542)
gaactgaagagtttgatcatggctcagattgaacgctggcggcaggcctaacacatgcaagtcgagcggaaacgatgggagcttgctcccaggcgtcgagcggcggacgggtgagtaacacgtgggaatctgcccattagtgggggataactcggggaaactcgagctaataccgcataatccctacgggggaaagcaggggatcttcggaccttgcgctgatggatgagcccgcgtcggattagcttgttggtggggtaatggcccaccaaggcgacgatccgtaactggtctgagaggatggccagtcacaccgggactgagacacggcccggactcctacgggaggcagcagtggggaatcttggacaatgggcgcaagcctgatccagccatgccgcgtgtgtgaagaaggccttcgggttgtaaagcactttcagtagggaggaaggcttcgggttaataccctggagtacttgacgttacctacagaagaagcaccggctaatttcgtgccagcagccgcggtaatacgaaaggtgcgagcgttaatcggaattactgggcgtaaagcgcgcgtaggcggtgtgttaagtcggatgtgaaagcccagggctcaaccttggaattgcatccgatactggcacgctagagtgcagtagagggaggtggaatttccggtgtagcggtgaaatgcgtagagatcggaaggaacaccagtggcgaaggcggcctcctggactgacactgacgctgaggtgcgaaagcgtggggagcaaacaggattagataccctggtagtccacgccgtaaacgatgtctactagccgttggggtccttagtgactttggtggcgcagctaacgcgataagtagaccgcctggggagtacggccgcaaggttaaaactcaaatgaattgacgggggcccgcacaagcggtggagcatgtggtttaattcgatgcaacgcgaagaaccttaccaggccttgacatcctgcgaactttctagagatagattggtgccttcgggagcgcagtgacaggtgctgcatggctgtcgtcagctcgtgtcgtgagatgttgggttaagtcccgtaacgagcgcaacccttgtccttagttgccagcacttcgggtgggaactctagggagactgccggtgacaaaccggaggaaggtggggacgacgtcaagtcatcatggcccttacggcctgggctacacacgtgctacaatggttggtacagagggttgcgaagtcgcgaggcggagctaatctctcaaagccaatcgtagtccggattggagtctgcaactcgactccatgaagtcggaatcgctagtaatcgcggatcagaatgccgcggtgaatacgttcccgggccttgtacacaccgcccgtcacaccatgggagtggattgcaccagaagtagttagtctaaccttcgggaggacgattaccacggtgtggttcatgactggggtgaagtcgtaacaaggtagccgtaggggaacctgcggctggatcacctccttaa

SEQ ID NO: 1249 - DNA, 1542 bp, Alcanivorax sp. MTEO17
  ref <308>: DATABASE ACCESSION NUMBER: NCBI ACCESSION: NZ_QYYA01000018.1
  ref <309>: DATABASE ENTRY DATE: 2019-04-01
  ref <313>: RELEVANT RESIDUES IN SEQ ID NO: (1)..(1542)
taactgaagagtttgatcatggctcagattgaacgctggcggcaggcctaacacatgcaagtcgagcggtaacaggagaagcttgcttctcgctgacgagcggcggacgggtgagtaacgcgtgagaatctgcccatttgtgggggataacttggggaaacccaagctaataccgcataatccctacgggggaaagcaggggaccttcgggccttgtgcagatggatgagctcgcgtcggattagctagttggtggggtaaaggcctaccaaggcgacgatccgtagctggtctgagaggatgatcagccacaccgggactgagacacggcccggactcctacgggaggcagcagtggggaatcttggacaatgggggcaaccctgatccagccatgccgcgtgtgtgaagaaggccctagggttgtaaagcactttcagtagggaggaaggcttcgggttaataccttggagtacttgacgttacctacagaagaagcaccggctaatttcgtgccagcagccgcggtaatacgaaaggtgcgagcgttaatcggaattactgggcgtaaagcgcgcgtaggcggtttgttaagtcagatgtgaaagccccgggctcaacctgggaattgcatttgaaactggcaagctagaatgcagtagagggaggtggaatttccggtgtagcggtgaaatgcgtagagatcggaaggaacaccagtggcgaaggcggcctcctggactgacattgacgctgaggtgcgaaagcgtggggagcaaacaggattagataccctggtagtccacgccgtaaacgatgtctactagtcgttgggaatcttagtattcttggtgacgaagttaacgcgataagtagaccgcctggggagtacggccgcaaggttaaaactcaaatgaattgacgggggcccgcacaagcggtggagcatgtggtttaattcgatgcaacgcgaagaaccttaccaggccttgacatccttggaactttctagagatagattggtgccttcgggagccaagtgacaggtgctgcatggctgtcgtcagctcgtgtcgtgagatgttgggttaagtcccgtaacgagcgcaacccttgtccctagttgccagcacttcgggtgggaactctagggagactgccggtgacaaaccggaggaaggtggggacgacgtcaagtcatcatggcccttacggcctgggctacacacgtgctacaatgggcggtacagagggcagcgaagtcgcgaggccaagcaaatcccttaaaaccgttcgtagtccggattggagtctgcaactcgactccatgaagtcggaatcgctagtaatcgcgaatcagaatgtcgcggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaa

SEQ ID NO: 1250 - DNA, 1542 bp, Alcanivorax xenomutans
  ref <308>: DATABASE ACCESSION NUMBER: NCBI ACCESSION: NZ_OBMO01000039.1
  ref <309>: DATABASE ENTRY DATE: 2019-04-01
  ref <313>: RELEVANT RESIDUES IN SEQ ID NO: (1)..(1542)
gaactgaagagtttgatcatggctcagattgaacgctggcggcaggcctaacacatgcaagtcgagcggaaacgatgggagcttgctcccaggcgtcgagcggcggacgggtgagtaacacgtgggaatctgcccattagtgggggataactcggggaaactcgagctaataccgcataatccctacgggggaaagcaggggatcttcggaccttgcgctgatggatgagcccgcgtcggattagcttgttggtggggtaatggcccaccaaggcgacgatccgtaactggtctgagaggatggccagtcacaccgggactgagacacggcccggactcctacgggaggcagcagtggggaatcttggacaatgggcgcaagcctgatccagccatgccgcgtgtgtgaagaaggccttcgggttgtaaagcactttcagtagggaggaaggctttgggctaataccctggagtacttgacgttacctacagaagaagcaccggctaatttcgtgccagcagccgcggtaatacgaaaggtgcgagcgttaatcggaattactgggcgtaaagcgcgcgtaggcggtgtgttaagtcggatgtgaaagcccagggctcaaccttggaattgcatccgatactggcacgctagagtgcagtagagggaggtggaatttccggtgtagcggtgaaatgcgtagagatcggaaggaacaccagtggcgaaggcggcctcctggactgacactgacgctgaggtgcgaaagcgtggggagcaaacaggattagataccctggtagtccacgccgtaaacgatgtctactagccgttggggtccttagtgactttggtggcgcagctaacgcgataagtagaccgcctggggagtacggccgcaaggttaaaactcaaatgaattgacgggggcccgcacaagcggtggagcatgtggtttaattcgatgcaacgcgaagaaccttaccaggccttgacatcctgcgaactttctagagatagattggtgccttcgggagcgcagtgacaggtgctgcatggctgtcgtcagctcgtgtcgtgagatgttgggttaagtcccgtaacgagcgcaacccttgtccttagttgccagcacttcgggtgggaactctagggagactgccggtgacaaaccggaggaaggtggggacgacgtcaagtcatcatggcccttacggcctgggctacacacgtgctacaatggttggtacagagggttgcgaagtcgcgaggcggagctaatctctcaaagccaatcgtagtccggattggagtctgcaactcgactccatgaagtcggaatcgctagtaatcgcggatcagaatgccgcggtgaatacgttcccgggccttgtacacaccgcccgtcacaccatgggagtggattgcaccagaagtagttagtctaaccttcgggaggacgattaccacggtgtggttcatgactggggtgaagtcgtaacaaggtagccgtaggggaacctgcggctggatcacctccttaa

SEQ ID NO: 1251 - DNA, 1521 bp, Algibacter aquaticus
  ref <308>: DATABASE ACCESSION NUMBER: NCBI ACCESSION: NZ_MDJD01000014.1
  ref <309>: DATABASE ENTRY DATE: 2019-04-01
  ref <313>: RELEVANT RESIDUES IN SEQ ID NO: (1)..(1521)
aacgatgaagagtttgatcctggctcaggatgaacgctagcggcaggcttaacacatgcaagtcgaggggtaacattgtagcttgctacagatgacgaccggcgcacgggtgcgtaacgcgtatacaatctaccttatactgagggatagcccagagaaatttggattaatacctcatagtatgtttaattggcatcaattagacattaaaggttacggtataagatgagtatgcgttctattagctagatggagtggtaacggcacaccatggcaacgatagataggggccctgagagggggatcccccacactggtactgagacacggaccagactcctacgggaggcagcagtgaggaatattggacaatggagggaactctgatccagccatgccgcgtgcaggatgactgccctatgggttgtaaactgcttttatacaggaagaaactgctctacgtgtagagatttgacggtactgtaagaataaggatcggctaactccgtgccagcagccgcggtaatacggaggatccaagcgttatccggaatcattgggtttaaagggtccgtaggtggataattaagtcaggggtgaaagtctgcagctcaactgtagaattgcccttgatactgtttatcttgagttattatgaagtagttagaatatgtagtgtagcggtgaaatgcatagatattacatagaataccaattgcgaaggcagattactaataatatactgacactgatggacgaaagcgtggggagcgaacgggattagataccccggtagtccacgccgtaaacgatggatactagctgttcggtttcgactgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagattgacatgtttagagatagacctttcttcggacaatttacaaggtgctgcatggttgtcgtcagctcgtgccgtgaggtgtcaggttaagtcctataacgagcgcaacccctgttgttagttgccagcatttcaagatgggaactctaacaagactgccagtgcaaactgtgaggaaggtggggatgacgtcaaatcatcacggcccttacgtcctgggctacacacgtgctacaatggtagggacagagagcagccacttggcgacaaggagcgaatctataaaccctatcacagttcggatcggagtctgcaactcgactccgtgaagctggaatcgctagtaatcgcatatcagccatgatgcggtgaatacgttcccgggccttgtacacaccgcccgtcaagccatggaagctgggagtgcctgaagtccgtcaccgagaggagcggcctagggtaaaatcggtaactagggctaagtcgtaacaaggtagccgtaccggaaggtgcggctggaacacctcctttct

SEQ ID NO: 1252 - DNA, 1527 bp, Algibacter sp. RHA 19
  ref <308>: DATABASE ACCESSION NUMBER: NCBI ACCESSION: NZ_PHUL01000001.1
  ref <309>: DATABASE ENTRY DATE: 2019-04-01
  ref <313>: RELEVANT RESIDUES IN SEQ ID NO: (1)..(1527)
caacgatgaagagtttgatcctggctcaggatgaacgctagcggcaggcttaacacatgcaagtcgaggggtaacaggggagcttgcttctgctgacgaccggcgcacgggtgcgtaacgcgtatacaatctgccttacactaagggatagcccagagaaatttggattaataccttatagtttattaagatggcatcattttaataataaagattacggtgtaagatgagtatgcgtaccattagtttgttggtaaggtaacggcttaccaagactacgatggttaggggccctgagagggggatcccccacactggtactgagacacggaccagactcctacgggaggcagcagtgaggaatattggacaatggaggagactctgatccagccatgccgcgtgcaggaagacggtcctatggattgtaaactgcttttatacaggaagaataaggactacgtgtagtctggtgacggtactgtaagaataaggaccggctaactccgtgccagcagccgcggtaatacggagggtccgagcgttatccggaattattgggtttaaagggtccgtaggcgggccattaagtcaggggtgaaagtttgcagctcaactgtagaattgcctttgatactgatggtcttgaattattgtgaagtggttagaatatgtagtgtagcggtgaaatgcatagatattacatagaataccgattgcgaaggcagatcactaacaatatattgacgctgatggacgaaagcgtgggtagcgaacaggattagataccctggtagtccacgccgtaaacgatggatactagctgtgtggttttcggactgcgcggccaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagattgacaggtttagagatagactttccttcgggcaatttacaaggtgctgcatggttgtcgtcagctcgtgccgtgaggtgtcaggttaagtcctataacgagcgcaacccctgttgttagttaccagcacattatggtggggactctagcaagactgccggtgcaaaccgtgaggaaggtggggatgacgtcaaatcatcacggcccttacgtcctgggccacacacgtgctacaatggtaggtacagagagcagccacttagcgataaggagcgaatctataaaacctatcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagttcgtcaccgcaaggagcgacctagggtaaaactggtaactagggctaagtcgtaacaaggtagccgtaccggaaggtgcggctggaacacctcctttctaga

SEQ ID NO: 1253 - DNA, 1526 bp, Algoriphagus antarcticus
  ref <308>: DATABASE ACCESSION NUMBER: NCBI ACCESSION: NZ_QUNF01000055.1
  ref <309>: DATABASE ENTRY DATE: 2019-04-01
  ref <313>: RELEVANT RESIDUES IN SEQ ID NO: (1)..(1526)
tttacaatggagagtttgatcctggctcaggatgaacgctagcggcaggcctaatacatgcaagttgaacggtagattactttcgggtagttgagagtggcgaacgggtgcgtaacgcgtatgcaacctaccctatacagggggatagcccggagaaatctggattaataccccatagtactatgatgaggcattttgttatagttaaagattcatcggtataggatgggcatgcgtctgattagctagttggcggtgtaacggaccaccaaggctacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatctgggaagaaaaagcccctgcgggggaaattgccggtaccagatgaataagcaccggctaactccgtgccagcagccgcggtaatacggagggtgcaagcgttgtccggatttattgggtttaaagggtgcgtaggcggctatttaagtcagtggtgaaagactccggctcaaccggagcagtgccattgatactggatagcttgagtattggaggggtacatggaattgatggtgtagcggtgaaatgcatagataccatcaggaacaccgatagcgaaggcattgtactggccaataactgacgctgatgcacgaaagcatgggtagcgaacaggattagataccctggtagtccatgccgtaaacgatgattactcgctgttatgctcttgtagtgtagcggccaagcgaaagcgttaagtaatccacctggggagtacgctcgcaagagtgaaactcaaaggaattgacgggggtccgcacaagcggtggagcatgtggtttaattcgatgatacgcgaggaaccttacctgggctagaatgtgagggaatgtattggagacagtacagtcagcaatgacccgaaacaaggtgctgcatggccgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaggtcatcatggcccttacgcccagggcgacacacgtgctacaatggcgcatacagcgggtagctacctggcaacaggatgccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaaggcagtaaccgtcaaggagctgtttagggtagaaccggtaactggggctaagtcgtaacaaggtagccgtaccggaaggtgcggctggaacacctcctttct

SEQ ID NO: 1254 - DNA, 1528 bp, Algoriphagus aquaeductus
  ref <308>: DATABASE ACCESSION NUMBER: NCBI ACCESSION: NZ_QKTX01000035.1
  ref <309>: DATABASE ENTRY DATE: 2019-04-01
  ref <313>: RELEVANT RESIDUES IN SEQ ID NO: (1)..(1528)
tttacaatggagagtttgatcctggctcaggatgaacgctagcggcaggcctaatacatgcaagtcgagcggcaagtcgaggagtaatctgagacctagagcggcgcacgggtgcgtaacgcgtatgcaacctaccttatactgggggatagcccggagaaatctggattaataccccatggtacatattgagggcatctgagatatgttaaagatttattggtatgagatgggcatgcgtctgattagctagttggcggggtaacggcccaccaaggcgacgatcagtaggggttctgagaggaaggtcccccacactggcactgagatacgggccagactcctacgggaggcagcagtagggaatattgggcaatggtcggaagactgacccagccatgccgcgtgcaggaagacggccctctgggttgtaaactgcttttatctgggaagaaaaaggccatgcgtggcaaattgccggtaccagatgaataagcaccggctaactccgtgccagcagccgcggtaatacggagggtgcaagcgttgtccggatttattgggtttaaagggtgcgtaggcggctatttaagtcagcggtgaaagactccggcttaaccggagcagtgccattgatactggatagcttgagtgttggaggggtacatggaattgatggtgtagcggtgaaatgcatagataccatcaggaacaccgatagcgaaggcattgtactggccaacaactgacgctgaggcacgaaagtgtggggatcgaacaggattagataccctggtagtccacactgtaaacgatgattactcgctgttatggagtattctgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgtttagttgccagcaagtaatgttggggactctagacagactgcctgcgcaagcagagaggaaggaggggacgacgtcaagtcatcatggcccttacgcccagggcgacacacgtgctacaatggcgcatacagcgggtcgcgagccggtaacggtaagccaacctctaaaagtgcgtctcagttcggattgaggtctgcaactcgacctcatgaagctggaatcgctagtaatcgcgcatcagccatggcgcggtgaatacgttcccggaccttgtacacaccgcccgtcaagccatggaagtcgggtagacctgaagacggtaaccgcgaggagccgtttagggtagaaccggtaactggggctaagtcgtaacaaggtagccgtaccggaaggtgcggctggaacacctcctttct

SEQ ID NO: 1255 - DNA, 1126 bp, Algoriphagus boritolerans
  ref <308>: DATABASE ACCESSION NUMBER: NCBI ACCESSION: NZ_FNVR01000075.1
  ref <309>: DATABASE ENTRY DATE: 2019-04-01
  ref <313>: RELEVANT RESIDUES IN SEQ ID NO: (1)..(1126)
ttacaatggagagtttgatcctggctcaggatgaacgctagcggcaggcctaatacatgcaagtcgagcggcaagtcgaggagtaatctaagacctagagcggcggacgggtgcgtaacgcgtatgcaacctacctcatacagggggatagcccggagaaatctggattaataccccatggtactgtgacaaggcattttgttatagttaaagattcatcggtatgagatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatctgggaagaaaaggcccatgcgtgggacattgccggtaccagatgaataagcaccggctaactccgtgccagcagccgcggtaatacggagggtgcaagcgttgtccggatttattgggtttaaagggtgcgtaggcggctgattaagtcagtggtgaaagacatcggctcaaccgatgcagtgccattgatactggtgagcttgagtgttggaggggtacatggaattgatggtgtagcggtgaaatgcatagataccatcaggaacaccgatagcgaaggcattgtacttgccaacaactgacgctgaggcacgaaagcatggggagcgaacaggattagataccctggtagtccatgccgtaaacgatgattactcgctgttatgctgtagagtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgtttagttgccagcacgt

SEQ ID NO: 1256 - DNA, 1524 bp, Algoriphagus chordae
  ref <308>: DATABASE ACCESSION NUMBER: NCBI ACCESSION: NZ_QKZT01000043.1
  ref <309>: DATABASE ENTRY DATE: 2019-04-01
  ref <313>: RELEVANT RESIDUES IN SEQ ID NO: (1)..(1524)
tttacaatggagagtttgatcctggctcaggatgaacgctagcggcaggcctaatacatgcaagtcgaacggtatattactttcgggtaatagagagtggcgaacgggtgcgtaacgcgtatgcaacctaccctatacagggggatagcccggagaaatctggattaataccccatggtatcattgaaccgcatggtttgatgcttaaagattcatcggtataggatgggcatgcgtctgattagctagttggcggtgtaacggaccaccaaggctacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatctgggaagaaaatgcccttgcgagggaaattgccggtaccagatgaataagcaccggctaactccgtgccagcagccgcggtaatacggagggtgcaagcgttgtccggatttattgggtttaaagggtgcgtaggcggctatttaagtcagtggtgaaagactccggctcaaccggagcagtgccattgatactggatagcttgagtattggaggggtacatggaattgatggtgtagcggtgaaatgcatagataccatcaggaacaccgatagcgaaggcattgtactggccaataactgacgctgatgcacgaaagcatgggtagcgaacaggattagataccctggtagtccatgccgtaaacgatgattactcgctgttatgtctttatgatgtagcggccaagcgaaagcgttaagtaatccacctggggagtacgctcgcaagagtgaaactcaaaggaattgacgggggtccgcacaagcggtggagcatgtggtttaattcgatgatacgcgaggaaccttacctgggctagaatgtgagggaatgtactggagacagtacagtcagcaatgacccgaaacaaggtgctgcatggccgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaggtcatcatggcccttacgcccagggcgacacacgtgctacaatggcgcatacagcgggtagctacctggcaacaggatgccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagttgggtagacctgaaggcagtaaccgttaaggagctgtttagggtagaaccggtaactggggctaagtcgtaacaaggtagccgtaccggaaggtgcggctggaacacctccttt

SEQ ID NO: 1257 - DNA, 1525 bp, Algoriphagus halophilus
  ref <308>: DATABASE ACCESSION NUMBER: NCBI ACCESSION: NZ_FSRC01000006.1
  ref <309>: DATABASE ENTRY DATE: 2019-04-01
  ref <313>: RELEVANT RESIDUES IN SEQ ID NO: (1)..(1525)
tttacaatggagagtttgatcctggctcaggatgaacgctagcggcaggcctaatacatgcaagtcgaacggtagattactttcgggtaattgagagtggcgcacgggtgcgtaacgcgtatgcaacctaccctatacagggggatagcccggagaaatctggattaataccccatagcactatgttgaggcatttcgatatagttaaagattcatcggtataggatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatctgggaagaaaaggcccatgcgtgggacattgccggtaccagatgaataagcaccggctaactccgtgccagcagccgcggtaatacggagggtgcaagcgttgtccggatttattgggtttaaagggtgcgtaggcggctatttaagtcagtggtgaaagactccggctcaaccggagcagtgccattgatactggatagcttgagtattggagaggtacatggaattgatggtgtagcggtgaaatgcatagataccatcaggaacaccgatagcgaaggcattgtactggccaataactgacgctgatgcacgaaagcatggggagcgaacaggattagataccctggtagtccatgccgtaaacgatgattactcgctgttatggctttatgttgtagcggccaagcgaaagcgttaagtaatccacctggggagtacgcccgcaagggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaagtcatcatggcccttacgcccagggcgacacacgtgctacaatggcgcatacagcgggtcgcgagccggtaacggtcagccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaagccagtaaccgcaaggagctgtttagggtagaaccggtaactggggctaagtcgtaacaaggtagccgtaccggaaggtgcggctggaacacctcctttct

SEQ ID NO: 1258 - DNA, 1527 bp, Algoriphagus machipongonensis
  ref <308>: DATABASE ACCESSION NUMBER: NCBI ACCESSION: NZ_CM001023.1
  ref <309>: DATABASE ENTRY DATE: 2019-04-01
  ref <313>: RELEVANT RESIDUES IN SEQ ID NO: (1)..(1527)
tttacaatggagagtttgatcctggctcaggatgaacgctagcggcaggcctaatacatgcaagtcgaacgagatttaagacttcggttttaatgaaagtggcgcacgggtgcgtaacgcgtatgcaacctaccctatacagggggatagcccggagaaatctggattaataccccatagcactgtgacgaggcattttgttacagttaaagattcatcggtataggatgggcatgcgtctgattagctagttgggggtgtaacggaccaccaaggcgacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatacgggaagaaaaggcccatgcgtgggacattgccggtaccgtatgaataagcaccggctaactccgtgccagcagccgcggtaatacggagggtgcaagcgttgtccggatttattgggtttaaagggtgcgtaggcggctatttaagtcagtggtgaaagactccggctcaaccggggcagtgccattgatactggatagcttgagtattggaggggtacatggaattgatggtgtagcggtgaaatgcatagataccatcaggaacaccgatagcgaaggcattgtactggccagtaactgacgctgatgcacgaaagcatggggagcgaacaggattagataccctggtagtccatgccgtaaacgatgattactcgctgttatgcctttatggtgtagcggccaagcgaaagcgttaagtaatccacctggggagtacgctcgcaagagtgaaactcaaaggaattgacgggggtccgcacaagcggtggagcatgtggtttaattcgatgatacgcgaggaaccttacctgggctagaatgtgagggaatgatttggagacagatcagtcagcaatgacccgaaacaaggtgctgcatggccgtcgtcagctcgtgccgtgaggtgttgggttaagtcccgcaacgagcgcaacccctatgttcagttgccagcacgtaatggtggggactctggacagactgcctgcgcaagcagagaggaaggaggggacgacgtcaggtcatcatggcccttacgcccagggcgacacacgtgctacaatggcgcatacagcgggtcgcgaaccggtaacggtgagccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaagacagtaaccgtaaggagctgtttagggtagaaccggtaactggggctaagtcgtaacaaggtagccgtaccggaaggtgcggctggaacacctcctttct

SEQ ID NO: 1259 - DNA, 1445 bp, Algoriphagus mannitolivorans
  ref <308>: DATABASE ACCESSION NUMBER: NCBI ACCESSION: NZ_AUBV01000023.1
  ref <309>: DATABASE ENTRY DATE: 2019-04-01
  ref <313>: RELEVANT RESIDUES IN SEQ ID NO: (1)..(1445)
agtaatacttcaatgagagcggcgcacgggtgcgtaacgcgtatgcaacctaccctttacagggggatagcccggagaaatctggattaataccccatggcactattgattggcatcaagagatagttaaagatttatcggtaaaggatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggtcggaagactgacccagccatgccgcgtgcaggaagacggcctattgggttgtaaactgcttttatctgggaagaaaaaggccatgcgtggcaaattgccggtaccagatgaataagcaccggctaactccgtgccagcagccgcggtaatacggagggtgcaagcgttgtccggatttattgggtttaaagggtgcgtaggcggctgtttaagtcagcggtgaaagactccggctcaaccggggcagtgccgttgatactggacagcttgagtgctgcaggggtacatggaattgatgatgtagcggtgaaatgcatagatatcatcaggaacaccgatagcgaaggcattgtactgggcagcaactgacgctgaggcacgaaagtgtggggatcgaacaggattagataccctggtagtccacaccgtaaacgatgattactcgctgttatgcttatatagtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgtttagttgccagcacgtaaaggtggggactctagacagactgcctgcgcaagcagagaggaaggaggggacgacgtcaagtcatcatggcccttacgcccagggcgacacacgtgctacaatggcgcatacagcgggtcgcgagccggtaacggtaagccaacctctaaaagtgcgtctcagttcggattgaggtctgcaactcgacctcatgaagctggaatcgctagtaatcgcgcatcagccatggcgcggtgaatacgttcccggaccttgtacacaccgcccgtcaagccatggaagtcgggtagacctgaaggcggtaaccgcaaggagccgtttagggtagaaccggtaactggggctaagtcgtaacaaggtagccgtaccggaaggtgcggctggaacacctccttt

SEQ ID NO: 1260 - DNA, 1529 bp, Algoriphagus marincola
  ref <308>: DATABASE ACCESSION NUMBER: NCBI ACCESSION: NZ_JAFX01000001.1
  ref <309>: DATABASE ENTRY DATE: 2019-04-01
  ref <313>: RELEVANT RESIDUES IN SEQ ID NO: (1)..(1529)
tatacaatggagagtttgatcctggctcaggatgaacgctagcggcaggcctaatacatgcaagtcgagcggtagagatgctttcgggtatcttgagagcggcgcacgggtgcgtaacacgtatgcaacctaccttatacagggggatagcccggagaaatccggattaataccccatggtatcattgaactgcatggtttgatgattaaagatttatcggtataagatgggcatgcgtctgattagctggttggtggggtaacggctcaccaaggcgacgatcagtaggggttctgagaggaaggtcccccacactggcactgagatacgggccagactcctacgggaggcagcagtagggaatattgggcaatggacgcgagtctgacccagccatgccgcgtgcaggaagacggcctattgggttgtaaactgcttttatacgggaagaaaaggcccatgcgtgggacattgccggtaccgtatgaataagcaccggctaactccgtgccagcagccgcggtaatacggagggtgcaagcgttgtccggatttattgggtttaaagggtgcgtaggcggctgattaagtcagcggtgaaagactccggctcaaccggggcagtgccgttgatactggttggcttgagtgctgcaggggtacatggaattgatggtgtagcggtgaaatgcatagataccatcaggaacaccgatagcgaaggcattgtactgggcagcaactgacgctgatgcacgaaagcgtggggagcgaacaggattagataccctggtagtccacgccgtaaacgatgattactcgctgttatgccttcgggtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttggagacagatcagtcagcaatgacctgaaacaaggtgctgcatggctgtcgtcagctcgtgccgtgaggtgttgggttaagtcccgcaacgagcgcaacccctatgttcagttgccagcaggtaaagctggggactctggacagactgcctgcgcaagcagagaggaaggaggggacgacgtcaagtcatcatggcccttacgcccagggcgacacacgtgctacaatggcgcatacagcgggtagcgagacggcaacgttgagccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaaggcggtaaccgcaaggagccgtttagggtagaaccggtaactggggctaagtcgtaacaaggtagccgtaccggaaggtgcggctggaacacctcctttctgga

SEQ ID NO: 1261 - DNA, 1526 bp, Algoriphagus ratkowskyi
  ref <308>: DATABASE ACCESSION NUMBER: NCBI ACCESSION: NZ_QKZU01000042.1
  ref <309>: DATABASE ENTRY DATE: 2019-04-01
  ref <313>: RELEVANT RESIDUES IN SEQ ID NO: (1)..(1526)
tttacaatggagagtttgatcctggctcaggatgaacgctagcggcaggcctaatacatgcaagtcgaacggtagattactttcgggtagttgagagtggcgaacgggtgcgtaacgcgtatgcaacctaccctatacagggggatagcccggagaaatctggattaataccccatggcactatgatgaagcatttcgttatagttaaagattcatcggtataggatgggcatgcgtctgattagctagttggcggtgtaacggaccaccaaggctacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatctgggaagaaaatgcccttgcgagggaaattgccggtaccagatgaataagcaccggctaactccgtgccagcagccgcggtaatacggagggtgcaagcgttgtccggatttattgggtttaaagggtgcgtaggcggctatttaagtcagtggtgaaagactccggctcaaccggagcagtgccattgatactggatagcttgagtattggaggggtacatggaattgatggtgtagcggtgaaatgcatagataccatcaggaacaccgatagcgaaggcattgtactggccaataactgacgctgatgcacgaaagcatgggtagcgaacaggattagataccctggtagtccatgccgtaaacgatgattactcgctgttatgcccttgtggtgtagcggccaagcgaaagcgttaagtaatccacctggggagtacgctcgcaagagtgaaactcaaaggaattgacgggggtccgcacaagcggtggagcatgtggtttaattcgatgatacgcgaggaaccttacctgggctagaatgtgagggaatgtattggagacagtacagtcagcaatgacccgaaacaaggtgctgcatggccgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaggtcatcatggcccttacgcccagggcgacacacgtgctacaatggcgcatacagcgggtcgctacctggtaacaggatgccaacctctaaaagtgcgtctcagttcggattgaggtctgcaactcgacctcatgaagctggaatcgctagtaatcgcgcatcagccatggcgcggtgaatacgttcccggaccttgtacacaccgcccgtcaagccatggaagttgggtagacctgaaggcagtaaccgtcaaggagctgtttagggtagaaccggtaactggggctaagtcgtaacaaggtagccgtaccggaaggtgcggctggaacacctcctttct

SEQ ID NO: 1262 - DNA, 1525 bp, Algoriphagus shivajiensis
tacaatggagagtttgatcctggctcaggatgaacgctagcggcaggcctaatacatgcaagtcgagcggcaagtcgagaagcaattcaagacctagagcggcgcacgggtgcgtaacgcgtatgcaacctacctcatacagggggatagcccggagaaatctggattaataccccatgggacagcacgagggcatctgagagctgttaaagattcatcggtatgagatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggtcggaagactgacccagccatgccgcgtgcaggaagacggccttctgggttgtaaactgcttttatctgggaagaaaaaggccatgcgtggcaaattgccggtaccagatgaataagcaccggctaactccgtgccagcagccgcggtaatacggagggtgcaagcgttgtccggatttattgggtttaaagggtgcgtaggcggctgattaagtcagcggtgaaagactccggctcaaccggggcagtgccgttgatactggtcagcttgagtgctgcaggggtacatggaattgatgatgtagcggtgaaatgcatagatatcatcaggaacaccgatagcgaaggcattgtactgggcagcaactgacgctgaggcacgaaagtgtggggatcgaacaggattagataccctggtagtccacaccgtaaacgatgattactcgctgttatgcggcatagtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgttttggagacagaacagtcagcaatgacctgaaacaaggtgctgcatggctgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaagtcatcatggcccttacgcccagggcgacacacgtgctacaatggcgcatacagcgggtcgcgagccggtaacggtaagccaacctctaaaagtgcgtctcagttcggattggggtctgcaactcgaccccatgaagctggaatcgctagtaatcgcgcatcagccatggcgcggtgaatacgttcccggaccttgtacacaccgcccgtcaagccatggaagtcgggtagacctgaagacggtaaccgtaaggagccgtttagggtagaaccggtaactggggctaagtcgtaacaaggtagccgtaccggaaggtgcggctggaacacctcctttc

SEQ ID NO: 1263 - DNA, 1526 bp, Algoriphagus sp. A40
  ref <308>: DATABASE ACCESSION NUMBER: NCBI ACCESSION: NZ_MUNY01000075.1
  ref <309>: DATABASE ENTRY DATE: 2019-04-01
  ref <313>: RELEVANT RESIDUES IN SEQ ID NO: (1)..(1526)
tttacaatggagagtttgatcctggctcaggatgaacgctagcggcaggcctaatacatgcaagtcgagcggcaagtcgaggagtaatctgagacctagagcggcgtacgggtgcgtaacgcgtatgcaacctacctcatacagggggatagcccggagaaatctggattaataccccatagcacagcacaagggcatctgcgagctgttaaagattcatcggtatgagatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggacgagagtctgacccagccatgccgcgtgcaggaagaaggcgttctgcgttgtaaactgcttttatctgggaagaaaaggcccatgcgtgggacattgccggtaccagatgaataagcaccggctaactccgtgccagcagccgcggtaatacggagggtgcaagcgttgtccggatttattgggtttaaagggtgcgtaggcggctatttaagtcagcggtgaaagactccggctcaaccggagcagtgccattgatactggatagcttgagtgttggaggggtacatggaattgatggtgtagcggtgaaatgcatagataccatcaggaacaccgatagcgaaggcattgtactggccaacaactgacgctgaggcacgaaagcatggggagcgaacaggattagataccctggtagtccatgccgtaaacgatgattactcgctgttatgctgtacagtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgtttagttgccagcacgtcaaggtggggactctagacagactgcctgcgcaagcagagaggaaggaggggacgacgtcaagtcatcatggcccttacgcccagggcgacacacgtgctacaatggcgcatacagcgggtcgctacctagcaataggatgccaacctctaaaagtgcgtctcagttcggattggggtctgcaactcgaccccatgaagctggaatcgctagtaatcgcgcatcagccatggcgcggtgaatacgttcccggaccttgtacacaccgcccgtcaagccatggaagtcgggtagacctgaaggcggtaaccgcaaggagccgtttagggtagaaccggtaactggggctaagtcgtaacaaggtagccgtaccggaaggtgcggctggaacacctccttt

SEQ ID NO: 1264 - DNA, 948 bp, Algoriphagus sp. DSL-12
  ref <308>: DATABASE ACCESSION NUMBER: NCBI ACCESSION: NZ_QGOL01000060.1
  ref <309>: DATABASE ENTRY DATE: 2019-04-01
  ref <313>: RELEVANT RESIDUES IN SEQ ID NO: (1)..(948)
ttacaatggagagtttgatcctggctcaggatgaacgctagcggcaggcctaatacatgcaagtcgagcggcaagtcgaggagtaatctaagacctagagcggcgcacgggtgcgtaacgcgtatgcaacctacctcatacagggggatagcccggagaaatctggattaataccccatggtactatgaagcggcattgttttatagttaaagattcatcggtatgagatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatctgggaagaaaaggcccatgcgtgggacattgccggtaccagatgaataagcaccggctaactccgtgccagcagccgcggtaatacggagggtgcaagcgttgtccggatttattgggtttaaagggtgcgtaggcggctatttaagtcagcggtgaaagacatcggctcaaccgatgcagtgccattgatactggatagcttgagtgttggaggggtacatggaattgatggtgtagcggtgaaatgcatagataccatcaggaacaccgatagcgaaggcattgtactggccaacaactgacgctgaggcacgaaagcatggggagcgaacaggattagataccctggtagtccatgccgtaaacgatgattactcgctgttatgccttgatggtgtagcggccaagcgaaagcgttaagtaatccacctggggagtacgccggcaacggtgaaactcaaaggaattgacgggggtccgcacaagcggtggagcatgtggt

SEQ ID NO: 1265 - DNA, 1526 bp, Algoriphagus sp. M8-2
  ref <308>: DATABASE ACCESSION NUMBER: NCBI ACCESSION: NZ_CP012836.1
  ref <309>: DATABASE ENTRY DATE: 2019-04-01
  ref <313>: RELEVANT RESIDUES IN SEQ ID NO: (1)..(1526)
tttacaatggagagtttgatcctggctcaggatgaacgctagcggcaggcctaatacatgcaagtcgagcggcagttgttctagcaatagaatgatgagagcggcgcacgggtgcgtaacgcgtatgcaacctaccttatactgggagatagcccggagaaatctggattaataccccatggcacatatttagggcatctgagatatgttaaagatttatcggtataagatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggtcggaagactgacccagccatgccgcgtgcaggaagacggccctctgggttgtaaactgcttttatctgggaagaaaaaggccatgcgtggcaaattgccggtaccagatgaataagcaccggctaactccgtgccagcagccgcggtaatacggagggtgcaagcgttgtccggatttattgggtttaaagggtgcgtaggcggctgaataagtcagcggtgaaagactccggcttaaccggagcagtgccgttgatactgtttagcttgagttctgcaggggtacatggaattgatgatgtagcggtgaaatgcatagatatcatcaggaacaccgatagcgaaggcattgtactgggcagcgactgacgctgaggcacgaaagtgtggggatcgaacaggattagataccctggtagtccacactgtaaacgatgattactcgctgttatgttgtatgatgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaagtcatcatggcccttacgcccagggcgacacacgtgctacaatggcgcatacagcgggtcgcgagccggtaacggtaagccaacctctaaaagtgcgtctcagttcggattgaggtctgcaactcgacctcatgaagctggaatcgctagtaatcgcgcatcagccatggcgcggtgaatacgttcccggaccttgtacacaccgcccgtcaagccatggaagtcgggtagacctgaagacggtaaccgtgaggagccgtttagggtagaaccggtaactggggctaagtcgtaacaaggtagccgtaccggaaggtgcggctggaacacctccttt

SEQ ID NO: 1266 - DNA, 1527 bp, Algoriphagus sp. N3
  ref <308>: DATABASE ACCESSION NUMBER: NCBI ACCESSION: NZ_QXML01000021.1
  ref <309>: DATABASE ENTRY DATE: 2019-04-01
  ref <313>: RELEVANT RESIDUES IN SEQ ID NO: (1)..(1527)
tttacaatggagagtttgatcctggctcaggatgaacgctagcggcaggcctaatacatgcaagtcgagcggcaagttgagaagcaattcgagacctagagcggcgtacgggtgcgtaacgcgtatgcaacctacctcatacagggggatagcccggagaaatctggattaataccccatagtacaacgcgagggcatctgagtgttgttaaagattcatcggtatgagatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggtcggaagactgacccagccatgccgcgtgcaggaagacggcgttctgcgttgtaaactgcttttatctgggaagaaaaggcccatgcgtgggacattgccggtaccagatgaataagcaccggctaactccgtgccagcagccgcggtaatacggagggtgcaagcgttgtccggatttattgggtttaaagggtgcgtaggcggctatttaagtcagcggtgaaagactccggcttaaccggagcagtgccattgatactggatagcttgagtgttggaggggtacatggaattgatggtgtagcggtgaaatgcatagataccatcaggaacaccgatagcgaaggcattgtactggccaacaactgacgctgaggcacgaaagtgtggggatcgaacaggattagataccctggtagtccacactgtaaacgatgattactcgctgttatgctgtatagtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaagtcatcatggcccttacgcccagggcgacacacgtgctacaatggcgcatacagcgggtcgcgagccggtaacggtaagccaacctctaaaagtgcgtctcagttcggattggggtctgcaactcgaccccatgaagctggaatcgctagtaatcgcgcatcagccatggcgcggtgaatacgttcccggaccttgtacacaccgcccgtcaagccatggaagtcgggtagacctgaaggcggtaaccgcgaggagccgtttagggtagaaccggtaactggggctaagtcgtaacaaggtagccgtaccggaaggtgcggctggaacacctcctttc

SEQ ID NO: 1267 - DNA, 1524 bp, Algoriphagus sp. XAY3209
  ref <308>: DATABASE ACCESSION NUMBER: NCBI ACCESSION: NZ_NIUC01000009.1
  ref <309>: DATABASE ENTRY DATE: 2019-04-01
  ref <313>: RELEVANT RESIDUES IN SEQ ID NO: (1)..(1524)
tacaatggagagtttgatcctggctcaggatgaacgctagcggcaggcctaatacatgcaagtcgagcggtagagatactttcgggtattttgagagcggcgcacgggtgcgtaacacgtatgcaacctaccttatacagggggatagcccggagaaatccggattaataccccatggtactgatggatggcatcgtttatcagttaaagatttatcggtataagatgggcatgcgtctgattagctagttggtgaggtaacggctcaccaaggcgacgatcagtaggggttctgagaggaaggtcccccacactggcactgagatacgggccagactcctacgggaggcagcagtagggaatattgggcaatggacgagagtctgacccagccatgccgcgtgcaggaagacggcctattgggttgtaaactgcttttatacgggaagaaaaggcccatgcgtgggacattgccggtaccgtatgaataagcaccggctaactccgtgccagcagccgcggtaatacggagggtgcaagcgttgtccggatttattgggtttaaagggtgcgtaggcggctgattaagtcagcggtgaaagacttcggctcaaccggagcagtgccgttgatactggttagcttgagtgctgcaggggtacatggaattgatggtgtagcggtgaaatgcatagataccatcaggaacaccgatagcgaaggcattgtactgggcagcaactgacgctgatgcacgaaagcgtggggagcgaacaggattagataccctggtagtccacgccgtaaacgatgattactcgctgttatgcctttgggtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgttcagttgccagcaagtaaagttggggactctggacagactgcctgcgcaagcagagaggaaggaggggacgacgtcaagtcatcatggcccttacgcccagggcgacacacgtgctacaatggcgcatacagcgggtagcgaaccggcaacggtgagccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaaggcggtaaccgcaaggagccgtttagggtagaaccggtaactggggctaagtcgtaacaaggtagccgtaccggaaggtgcggctggaacacctcctttct

SEQ ID NO: 1268 - DNA, 1529 bp, Algoriphagus terrigena
  ref <308>: DATABASE ACCESSION NUMBER: NCBI ACCESSION: NZ_AUBW01000056.1
  ref <309>: DATABASE ENTRY DATE: 2019-04-01
  ref <313>: RELEVANT RESIDUES IN SEQ ID NO: (1)..(1529)
tttacaatggagagtttgatcctggctcaggatgaacgctagcggcaggcctaatacatgcaagtcgagcggcaagtcgaggagtaatctgagacctagagcggcgtacgggtgcgtaacgcgtatgcaacctacctcatacagggggatagcccggagaaatctggattaataccccatggcacagcacaagggcatctgcgagctgttaaagattcatcggtatgagatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatctgggaagaaaaagtccatgcgtggaaaattgccggtaccagatgaataagcaccggctaactccgtgccagcagccgcggtaatacggagggtgcaagcgttgtccggatttattgggtttaaagggtgcgtaggcggctatttaagtcagcggtgaaagacatcggctcaaccgatgcagtgccattgatactggatagcttgagtgttggaggggtacatggaattgatggtgtagcggtgaaatgcatagataccatcaggaacaccgatagcgaaggcattgtactggccaacaactgacgctgaggcacgaaagcatgggtagcgaacaggattagataccctggtagtccatgccgtaaacgatgattactcgctgttatgccgtagggtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgagggaatggcttggagacaggccagtccgcaaggacccgaaacaaggtgctgcatggccgtcgtcagctcgtgccgtgaggtgttgggttaagtcccgcaacgagcgcaacccctatgtttagttgccagcacgtaatggtggggactctagacagactgcctgtgcaaacagagaggaaggaggggacgacgtcaggtcatcatggcccttacgcccagggcgacacacgtgctacaatggcgcatacagcgggtcgctacctggcaacaggatgccaacctctaaaagtgcgtctcagttcggattggggtctgcaactcgaccccatgaagctggaatcgctagtaatcgcgcatcagccatggcgcggtgaatacgttcccggaccttgtacacaccgcccgtcaagccatggaagtcgggtagacctgaaggcggtaaccaattaggagccgtttagggtagaaccggtaactggggctaagtcgtaacaaggtagccgtaccggaaggtgcggctggaacacctcctttct

SEQ ID NO: 1269 - DNA, 1437 bp, Algoriphagus vanfongensis
  ref <308>: DATABASE ACCESSION NUMBER: NCBI ACCESSION: NZ_AUBX01000006.1
  ref <309>: DATABASE ENTRY DATE: 2019-04-01
  ref <313>: RELEVANT RESIDUES IN SEQ ID NO: (1)..(1437)
tttacaatggagagtttgatcctggctcaggatgaacgctagcggcaggcctaatacatgcaagtcgaacgagatttgagacttcggtttcaatgaaagtggcgcacgggtgcgtaacacgtatgcaacctacctcttacagggggatagcccggggaaacccggattaataccccatggtactattgattggcatcatgagatagttaaagatttatcggtaagagatgggcatgcgtctgattagctagttggtggtgtaacggaccaccaaggcgacgatcagtaggggttctgagaggaaggtcccccacactggcactgagatacgggccagactcctacgggaggcagcagtagggaatattgggcaatgggcgagagcctgacccagccatgccgcgtgcaggaagacggcctattgggttgtaaactgcttttatctgggaagaaaatgctcctgcgggggaaattgccggtaccagatgaataagcaccggctaactccgtgccagcagccgcggtaatacggagggtgcaagcgttgtccggatttattgggtttaaagggtgcgtaggcggcctgttaagtcagcggtgaaagaccacggctcaaccgtggcagtgccgttgatactggcaggcttgagtgctgcaggggtacatggaattgatggtgtagcggtgaaatgcatagataccatcaggaacaccgatagcgaaggcattgtactgggcagcaactgacgctgatgcacgaaagcatgggtagcgaacaggattagataccctggtagtccatgccgtaaacgatgattactcgctgttatgcctttaggtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaagtcatcatggcccttacgcccagggcgacacacgtgctacaatggcgcatacagcgggtagcgagccggcaacggtcagccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaagacagtaaccgc

SEQ ID NO: 1270 - DNA, 1526 bp, Algoriphagus yeomjeoni
  ref <308>: DATABASE ACCESSION NUMBER: NCBI ACCESSION: NZ_QLLK01000032.1
  ref <309>: DATABASE ENTRY DATE: 2019-04-01
  ref <313>: RELEVANT RESIDUES IN SEQ ID NO: (1)..(1526)
tttacaatggagagtttgatcctggctcaggatgaacgctagcggcaggcctaatacatgcaagtcgaacggtagattactttcgggtagttgagagtggcgaacgggtgcgtaacgcgtatgcaacctaccctatacagggggatagcccggagaaatctggattaataccccatagtatcattgagctgcatggtttaatgattaaagattcatcggtataggatgggcatgcgtctgattagctagttggcggtgtaacggaccaccaaggctacgatcagtaggggttctgagaggaaggtcccccacactggcactgagatacgggccagactcctacgggaggcagcagtagggaatattgggcaatggacgagagtctgacccagccatgccgcgtgcaggaagacggcgttctgcgttgtaaactgcttttatctgggaagaaaatgcccctgcgggggaaattgccggtaccagatgaataagcaccggctaactccgtgccagcagccgcggtaatacggagggtgcaagcgttgtccggatttattgggtttaaagggtgcgtaggcggctatttaagtcagtggtgaaagactccggctcaaccggagcagtgccattgatactggatagcttgagtattggaggggtacatggaattgatggtgtagcggtgaaatgcatagataccatcaggaacaccgatagcgaaggcattgtactggccaataactgacgctgatgcacgaaagcatgggtagcgaacaggattagataccctggtagtccatgccgtaaacgatgattactcgctgttatgccctagtggtgtagcggccaagcgaaagcgttaagtaatccacctggggagtacgctcgcaagagtgaaactcaaaggaattgacgggggtccgcacaagcggtggagcatgtggtttaattcgatgatacgcgaggaaccttacctgggctagaatgtgagggaatggtttggagacagatcagtcagcaatgacccgaaacaaggtgctgcatggccgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaggtcatcatggcccttacgcccagggcgacacacgtgctacaatggcgcatacagcgggtagctacctggcaacaggatgccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaaggcagtaaccgtcaaggagctgtttagggtagaaccggtaactggggctaagtcgtaacaaggtagccgtaccggaaggtgcggctggaacacctcctttct

SEQ ID NO: 1271 - DNA, 1528 bp, Algoriphagus zhangzhouensis
  ref <308>: DATABASE ACCESSION NUMBER: NCBI ACCESSION: NZ_FRXN01000014.1
  ref <309>: DATABASE ENTRY DATE: 2019-04-01
  ref <313>: RELEVANT RESIDUES IN SEQ ID NO: (1)..(1528)
tttacaatggagagtttgatcctggctcaggatgaacgctagcggcaggcctaatacatgcaagtcgaacgagatttgagacttcggtttcaatgaaagtggcgcacgggtgcgtaacacgtatgcaacctacctcttacagggggatagcccggggaaactcggattaataccccatggtactatagattggcatcatgaaatagttaaagattcatcggtaagagatgggcatgcgtctgattagctagttggcggtgtaacggaccaccaaggcgacgatcagtaggggttctgagaggaaggtcccccacactggcactgagatacgggccagactcctacgggaggcagcagtagggaatattgggcaatggacgagagtctgacccagccatgccgcgtgcaggaagacggcctattgggttgtaaactgcttttatctgggaagaaaaggcccatgcgtgggacattgccggtaccagatgaataagcaccggctaactccgtgccagcagccgcggtaatacggagggtgcaagcgttgtccggatttattgggtttaaagggtgcgtaggcggccaattaagtcagtggtgaaagacttcggctcaaccggagcagtgccattgatactggttggcttgagtgctgcaggggtacatggaattgatggtgtagcggtgaaatgcatagataccatcaggaacaccgatagcgaaggcattgtactgggcagcaactgacgctgatgcacgaaagcatgggtagcgaacaggattagataccctggtagtccatgccgtaaacgatgattactcgctgttatgcctatatggtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctatgtttagttgccagcacgtaatggtggggactctagacagactgcctgcgcaagcagagaggaaggaggggacgacgtcaagtcatcatggcccttacgcccagggcgacacacgtgctacaatggcgcatacagcgggtagcgagccggcaacggtcagccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaagacagtaaccgttaaggagctgtttagggtagaaccggtaactggggctaagtcgtaacaaggtagccgtaccggaaggtgcggctggaacacctcctttct

SEQ ID NO: 1272 - DNA, 431 bp, Alicyclobacillus acidiphilus
  ref <308>: DATABASE ACCESSION NUMBER: NCBI ACCESSION: NZ_BCQI01000117.1
  ref <309>: DATABASE ENTRY DATE: 2019-04-01
  ref <313>: RELEVANT RESIDUES IN SEQ ID NO: (1)..(431)
gtgttaccagcacgtaaaggtggggactcacaggtgactgccggcgtaagtcggaggaaggcggggatgacgtcaaatcatcatgcccttgatgtcctgggctacacacgtgctacaatgggcggtacagagggaagcgaagccgcgaggtggagccaaacctagaaagccgttcgtagttcggattgcaggctgcaactcgcctgcatgaagccggaattgctagtaatcgcggatcagcatgccgcggtgaatccgttcccgggccttgtacacaccgcccgtcacaccacgagagtcggcaacacccgaagtcggtgaggcaacccgcaagggagccagccgccgaaggtggggttgatgattggggtgaagtcgtaacaaggtagccgtatcggaaggtgcggctggatcacctcctttctatggag

SEQ ID NO: 1273 - DNA, 1552 bp, Alicyclobacillus acidocaldarius
  ref <308>: DATABASE ACCESSION NUMBER: NCBI ACCESSION: NC_017167.1
  ref <309>: DATABASE ENTRY DATE: 2019-04-01
  ref <313>: RELEVANT RESIDUES IN SEQ ID NO: (1)..(1552)
gattgagagttttgatcctggctcaggacgaacgctggcggcgtgcctaatacatgcaagtcgagcggacctcttttgaggtcagcggcggacgggtgaggaacacgtgggtaatctgcctttcagaccggaataacgcccggaaacgggcgctaatgccggatacgcccgcgaggaggcatcttcttgcggggaaaggcccggatgggccgctgagagaggagcccgcggcgcattagctagttggcggggtaacggcccaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctctgttgctcggggagagcggcatggggagtggaaagccccatgcgagacggtaccgagtgaggaagcccccggctaactacgtgccagcagccgcggtaaaaacgtagggggcgagcgttgtccggaatcactgggcgtaaagggtgcgtaggcggtcgagcaagtctggagtgaaagtccatggctcaaccatgggatggctctggaaactgcttgacttgagtgctggagaggcaaggggaattccacgtgtagcggtgaaatgcgtagagatgtggaggaataccagtcggcgaaggcgccttgctggacagtgactgacgctgaggcacgaaagcgtgggggagcaaacaggattagataccctggtagtccacgccgtaaacgatgagtgctaggtgttggggggacacaccccagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgggtgcagagatgcaccttcccttcgggggcagaggagacaggtggtgcatggttgtcgtcagctcgtgtcgtgagatgttgggttcagtcccgcaacgagcgcaacccttgacctgtgttaccagcgcgttgaggcgggggactcacaggtgactgccggcgcaagtcggaggaaggcggggatgacgtcaaatcatcatgcccctgatgtcctgggctacacacgtgctacaatgggcggtacaaagggaggcgaagccgcgaggcggagcgaaacccaaaaagccgctcgtagttcggattgcaggctgcaactcgcctgcatgaagccggaattgctagtaatcgcggatcagcatgccgcggtgaatacgttcccgggccttgtacacaccgcccgtcacaccacgagagtcggcaacacccgaagtcggtgaggtaaccccgaaaggggagccagccgccgaaggtggggtcgatgattggggtgaagtcgtaacaaggtagccgtaccggaaggtgcggctggatcacctcctttctagggaga

SEQ ID NO: 1274 - DNA, 1541 bp, Alicyclobacillus acidoterrestris
  ref <308>: DATABASE ACCESSION NUMBER: NCBI ACCESSION: NZ_AURB01000138.1
  ref <309>: DATABASE ENTRY DATE: 2019-04-01
  ref <313>: RELEVANT RESIDUES IN SEQ ID NO: (1)..(1541)
ttttttgagagtttgatcctggctcaggacgaacgctggcggcgtgcctaatacatgcaagtcgagcgagcccttcggggctagcggcggacgggtgagtaacacgtgggcaatctgcctttcagactggaataacactcggaaacgggtgctaatgccggataatacacgggtaggcatctacttgtgttgaaagatgcaactgcatcgctgagagaggagcccgcggcgcattagctagttggtgaggtaacggctcaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctctgttgctcggggagagcgacaaggagagtggaaagctccttgtgagacggtaccgagtgaggaagccccggctaactacgtgccagcagccgcggtaatacgtagggggcaagcgttgtccggaatcactgggcgtaaagcgtgcgtaggcggttgtgtaagtctgaagtgaaagtccaaggctcaaccttgggattgctttggaaactgcatgacttgagtgctggagaggcaaggggaattccacgtgtagcggtgaaatgcgtagatatgtggaggaataccagtggcgaaggcgccttgctggacagtgactgacgctgaggcacgaaagcgtggggagcaaacaggattagataccctggtagtccacgccgtaaacgatgagtgctaggtgttggggggacacaccccagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgaccggtgcagagatgtaccttcccttcggggcagaggagacaggtggtgcatggttgtcgtcagctcgtgtcgtgagatgttgggttaagtcccgcaacgagcgcaacccttgatctgtgttaccagcacgtagaggtggggactcacaggtgactgccggcgtaagtcggaggaaggcggggatgacgtcaaatcatcatgccctttatgtcctgggctacacacgtgctacaatgggcggtacaacgggaagcgaagccgcgaggtggagcaaaacctaaaaagccgttcgtagttcggattgcaggctgcaactcgcctgcatgaagccggaattgctagtaatcgcggatcagcatgccgcggtgaatccgttcccgggccttgtacacaccgcccgtcacaccacgagagtcggcaacacccgaagtcggtgaggtaaccgttatggagccagccgccgaaggtggggttgatgattggggtgaagtcgtaacaaggtagccgtatcggaaggtgcggctggatcacctcctttctacggaga

SEQ ID NO: 1275 - DNA, 1540 bp, Alicyclobacillus ferrooxydans
  ref <308>: DATABASE ACCESSION NUMBER: NCBI ACCESSION: NZ_LJCO01000007.1
  ref <309>: DATABASE ENTRY DATE: 2019-04-01
  ref <313>: RELEVANT RESIDUES IN SEQ ID NO: (1)..(1540)
tttgagagtttgatcctggctcaggacgaacgctggcggcgtgcctaatacatgcaagtcgcgcggacttcttcggaagtcagcggcggacgggtgagtaacacgtgggcaatctgcctcttagactggaataacgcctggaaacgggtgctaatgccagatagagcaacggacaggcatctgtttgttgggaaaggtgctacggcatcgctaagagaggagcccgcggcgcattagctagttggtggggtaacggcctaccaaggcgacgatgcgtagccgacctgagagggtgaccggccacactgggactgagacacggcccagactcctacgggaggcagcagtagggaatcttcggcaatgggcgcaagcctgaccgagcaacgccgcgtgagcgaagaaggccttcgggttgtaaagctcagtcatccgggaagagagaccaggggagggaatgcccctggagagacggtaccgggagaggaagccccggctaactacgtgccagcagccgcggtaatacgtagggggcaagcgttgtccggaatcactgggcgtaaagcgtgcgtaggcggtttgttaagtctgaagtgaaaggccatggctcaaccatgggaatgctttggaaactggcagacttgagtactggagaggcaaggggaattccacgtgtagcggtgaaatgcgtagagatgtggaggaataccagtggcgaaggcgccttgctggacagtgactgacgctgaggcacgaaagcgtggggagcaaacaggattagataccctggtagtccacgccgtaaacgatgagtgctaggtgttggaggttcagaccttcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgaccggtgtagagatacaccttcccttcggggcagaggagacaggtggtgcatggttgtcgtcagctcgtgtcgtgagatgttgggttaagtcccgcaacgagcgcaacccttgacctgtgttaccagcacgtaatggtggggactcacaggtgactgccggcgtaagtcggaggaaggtggggatgacgtcaaatcatcatgccccttatgtcctgggcaacacacgtgctacaatgggcggaacaacgggaagcgagaccgcgaggtggagcgaacccctgaaaaccgttcgtagttcggattgcaggctgcaacccgcctgcatgaagccggaattgctagtaatcgcggatcagcatgccgcggtgaatccgttcccgggccttgtacacaccgcccgtcacaccacgagagttggcaacacccgaagtcggtggggtaaccttataggggccagccgccgaaggtggggctgatgattggggtgaagtcgtaacaaggtagccgtatcggaaggtgcggctggatcacctcctttctatggag

SEQ ID NO: 1276 - DNA, 297 bp, Alicyclobacillus herbarius
  ref <308>: DATABASE ACCESSION NUMBER: NCBI ACCESSION: NZ_AUMH01000004.1
  ref <309>: DATABASE ENTRY DATE: 2019-04-01
  ref <313>: RELEVANT RESIDUES IN SEQ ID NO: (1)..(297)
cttttgttgagagtttgatcctggctcaggacgaacgctggcggcgtgcctaatacatgcaagtcgagcggacggaagggagcttgctcccggacgtcagcggcggacgggtgaggaacacgtgggcaatctgcccatcagtcgggaataacactcggaaacgggtgctaatgccggataggcatcttgggggcatccctgggatgggaaaggcgctaaggcgctgctgatggaggagcccgcggcgcattagctggttggcggggtaacggcccaccaaggcgacgatgcgtagcc

SEQ ID NO: 1277 - DNA, 1549 bp, Alicyclobacillus kakegawensis
  ref <308>: DATABASE ACCESSION NUMBER: NCBI ACCESSION: NZ_BCRP01000048.1
  ref <309>: DATABASE ENTRY DATE: 2019-04-01
  ref <313>: RELEVANT RESIDUES IN SEQ ID NO: (1)..(1549)
gagagtttgatcctggctcaggacgaacgctggcggcgtgcctaatacatgcaagtcgagcgggtcttgaggggcttgccccttgaggccagcggcggacgggtgaggaacacgtgggtaatctgcccatcagtcgggaataacacccggaaacgggtgctaaagccggataggcattctgggggcatccccgggatgggaaaagcggttttcgctgctgatggaggagcccgcggcgcattagctagttggtggggtaaaggcctaccaaggcgacgatgcgtagccggcctgagagggtgaacggccacactgggactgagacacggcccagactcctacgggaggcagcagtagggaatcttccgcaatgggcgcaagcctgacggagcaacgccgcgtgagcgaagaaggccttcgggttgtaaagctcagtcaatcgggaagagcgacctagggagggaatgccctaggggagacggtaccgatggaggaagccccggcaaactacgtgccagcagccgcggtaatacgtagggggcgagcgttgtccggaatgactgggcgtaaagggtgcgtaggcggcctgacacgtctggggtgaaaggccacggctcaaccgtgggggtgccctggaaacggtgaggcttgagtgctggagaggcaaggggaattccacgtgtagcggtgaaatgcgtagagatgtggaggaatacctgtggcgaaggcgccttgctggacagtgactgacgctgaggcacgaaagcgtggggagcgaacaggattagataccctggtagtccacgctgtaaacgatgagtgctaggtgttgggggtgcgagccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgcgtgcagagatgtgcgttcccttcggggcagaggagacaggtggtgcatggttgtcgtcagctcgtgtcgtgagatgttgggttaagtcccgcaacgagcgcaacccttgacctgtgttaccagcgcgtgaaggcggggactcacaggtgactgccggcgcaagccggaggaaggcggggatgacgtcaaatcatcatgcccttgatgtcctgggcgacacacgtgctacaatgggcggtacaacggggggcgaagccgcgaggcggagcgaatccctgaaagccgttcgtagttcggattgcaggctgcaacccgcctgcatgaagccggaattgctagtaatcgcggatcagcatgccgcggtgaatccgttcccgggccttgtacacaccgcccgtcacaccacgagagtgagcaacacccgaagtcggtgaggcaaccggagacggagccagccgccgaaggtggggctcgcgattggggtgaagtcgtaacaaggtagccgtatcggaaggtgcggctggatcacctcctttctacggaga

SEQ ID NO: 1278 - DNA, 1473 bp, Alicyclobacillus macrosporangiidus
  ref <308>: DATABASE ACCESSION NUMBER: NCBI ACCESSION: NZ_FPBV01000074.1
  ref <309>: DATABASE ENTRY DATE: 2019-04-01
  ref <313>: RELEVANT RESIDUES IN SEQ ID NO: (1)..(1473)
ctggaatcagcggcggacgggtgagtaacacgtgggcaatctgcctgtcagaccggaataacgcctggaaacgggtgctaatgccggatagagcaatgggcaggcatctgcctgttgggaaaggcgcgaatgcgctgctgacagaggagcccgcggcgcattagctagttggcggggtaacggcccaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctcagtcacccgggaagagcgacctgcggagtggaaagccgcaggggagacggtaccgggagaggaagccccggcaaactacgtgccagcagccgcggtaatacgtagggggcgagcgttgtccggaatcactgggcgtaaagcgtgcgtaggcggtcaagcaagtccgaggtgaaagaccgaggctcaacctcggggtggccttggaaactgtttgacttgagtgctggagaggcaaggggaattccacgtgtagcggtgaaatgcgtagatatgtggaggaataccagtggcgaaggcgccttgctggacagtgactgacgctgaggcacgaaagcgtggggagcaaacaggattagataccctggtagtccacgccgtaaacgatgagtgctaggtgttgggggggttacccttcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacaggtgcagagatgcaccctcccttcggggcagaggagacaggtggtgcatggttgtcgtcagctcgtgtcgtgagatgttgggttaagtcccgcaacgagcgcaacccttgacctgtgttaccagcgcgtaatggcggggactcacaggtgactgccggcgtaagtcggaggaaggtggggatgacgtcaaatcatcatgccctttatgtcctgggctacacacgtgctacaatgggcggtacaacgggaagcgaggccgcgaggcggagcaaacccctgaaagccgcccccagttcggattgcaggctgcaactcgcctgcatgaagccggaattgctagtaatcgcggatcagcatgccgcggtgaatacgttcccgggccttgtacacaccgcccgtcacaccacgagagtcggcaacacccgaagtcggtgaggtaaccctcgcaagagggggccagccgccgaaggtggggctgatgattggggtgaagtcgtaacaaggtagccgtatcggaaggtgcggctggatcacctcctttctagggag

SEQ ID NO: 1279 - DNA, 1534 bp, Alicyclobacillus mali
  ref <308>: DATABASE ACCESSION NUMBER: NCBI ACCESSION: NZ_BCSG01000065.1
  ref <309>: DATABASE ENTRY DATE: 2019-04-01
  ref <313>: RELEVANT RESIDUES IN SEQ ID NO: (1)..(1534)
gagagtttgatcctggctcaggacgaacgctggcggcgtgcctaatacatgcaagtcgagcgggtctcttcggaggccagcggcggacgggtgaggaacacgtgggtaatctgcctttcaggccggaataacgcccggaaacgggcgctaatgccggatacgcccgcgaggaggcatcttcttgcgggggaaggcccaactgggccgctgagagaggagcccgcggcgcattagctagttggcggggtaacggcccaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctctgttgctcggggagagcggcatgggggatggaaagccccatgcgagacggtaccgagtgaggaagccccggctaactacgtgccagcagccgcggtaaaacgtagggggcgagcgttgtccggaatcactgggcgtaaagggtgcgtaggcggtcgagcaagtctggagtgaaagtccatggctcaaccatgggatggctttggaaactgcttgacttgagtgctggagaggcaaggggaattccacgtgtagcggtgaaatgcgtagagatgtggaggaataccagtggcgaaggcgccttgctggacagtgactgacgctgaggcacgaaagcgtggggagcaaacaggattagataccctggtagtccacgccgtaaacgatgagtgctaggtgttggggggacacaccccagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacaccctcagagatgaggggtcccttcggggcagaggagacaggtggtgcatggttgtcgtcagctcgtgtcgtgagatgttgggttcagtcccgcaacgagcgcaacccttgacctgtgttaccagcgcgttgaggcggggactcacaggtgactgccggcgtaagtcggaggaaggcggggatgacgtcaaatcatcatgcccctgatgtcctgggctacacacgtgctacaatgggcggaacaaagggaggcgaagccgcgaggcggagcgaaacccaaaaagccgctcgtagttcggattgcaggctgcaactcgcctgcatgaagccggaattgctagtaatcgcggatcagcatgccgcggtgaatacgttcccgggccttgtacacaccgcccgtcacaccacgagagtcggcaacacccgaagtcggtgaggtaacccctctggggagccagccgccgaaggtggggtcgatgattggggtgaagtcgtaacaaggtagccgtaccggaaggtgcggctggatcacctcctttcta

SEQ ID NO: 1280 - DNA, 1294 bp, Alicyclobacillus montanus
  ref <308>: DATABASE ACCESSION NUMBER: NCBI ACCESSION: NZ_FRAF01000067.1
  ref <309>: DATABASE ENTRY DATE: 2019-04-01
  ref <313>: RELEVANT RESIDUES IN SEQ ID NO: (1)..(1294)
agggtaaaggcctaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaggaaggccttcgggttgtaaagctcagtcaagggggaagagcggcaaggagagggaatgctctttgcgagacggtaccccgagaggaagccccggcaaactacgtgccagcagccgcggtaatacgtagggggcaagcgttgtccggaatcactgggcgtaaagggtgcgtaggcggttctgcaagtctggggtgaaaggccagggctcaaccttgggaatgccttggaaactgtaggacttgagtactggagaggcaaggggaattccacgtgtagcggtgaaatgcgtagagatgtggaggaataccagtggcgaaggcgccttgctggacagtgactgacgctgaggcacgaaagcgtggggagcaaacaggattagataccctggtagtccacgccgtaaacgatgagtgctaggtgttggggggtaccaccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgataccagagatggtaggtcccttcggggcagaggagacaggtggtgcatggttgtcgtcagctcgtgtcgtgagatgttgggttaagtcccgcaacgagcgcaacccttgacctgtgttaccagcacgtagaggtggggactcacaggtgactgccggcgcaagtcggaggaaggcggggatgacgtcaaatcatcatgcccctgatgtcctgggcgacacacgtgctacaatgggcggcacaacgggaagcgagagagcgatctggagcgaacccctgaaaaccgctcgtagttcggattgcaggctgcaactcgcctgcatgaagccggaattgctagtaatcgcggatcagcatgccgcggtgaatccgttcccgggccttgtacacaccgcccgtcacaccacgagagttggcaacacccgaagtcggtggggtaacccgaaagggggccagccgccgaaggtggggtcgatgattggggtgaagtcgtaacaaggtagccgtatcggaaggtgcggctggatcacctcctttctaggga

SEQ ID NO: 1281 - DNA, 1542 bp, Alicyclobacillus sendaiensis
  ref <308>: DATABASE ACCESSION NUMBER: NCBI ACCESSION: NZ_BCRQ01000101.1
  ref <309>: DATABASE ENTRY DATE: 2019-04-01
  ref <313>: RELEVANT RESIDUES IN SEQ ID NO: (1)..(1542)
ttgagagtttgatcctggctcaggacgaacgctggcggcgtgcctaatacatgcaagtcgagcggacctcttcggaggtcagcggcggacgggtgaggaacacgtgggtaatctgcctttcagaccggaataacgcccggaaacgggcgctaatgccggatgcgcccgcgagggggcatcttcttgcggggaaaggcccagatgggccgctgagagaggagcccgcggcgcattagctcgttggcggggtaacggcccaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaggaaggccttcgggttgtaaagctctgttgctcggggagagcggcatggggagtggaaagtcccatgcgagacggtaccgagtgaggaagccccggctaactacgtgccagcagccgcggtaaaacgtagggggcgagcgttgtccggaatcactgggcgtaaagggtgcgtaggcggtcgagcaagtctggagtgaaagtccatggctcaaccatgggatggctctggaaactgcttgacttgagtgctggagaggcaaggggaattccacgtgtagcggtgaaatgcgtagagatgtggaggaataccagtggcgaaggcgccttgctggacagtgactgacgctgaggcacgaaagcgtggggagcaaacaggattagataccctggtagtccacgccgtaaacgatgagtgctaggtgttggggggacacaccccagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacaccctcagagatgaggggtcccttcggggcagaggagacaggtggtgcatggttgtcgtcagctcgtgtcgtgagatgttgggttcagtcccgcaacgagcgcaacccttgacctgtgttaccagcgcgaaagggcggggactcacaggtgactgccggcgtaagtcggaggaaggcggggatgacgtcaaatcatcatgcccctgatgtcctgggctacacacgtgctacaatgggcggtacaaagggaggcgaagccgcgaggcggagcgaaacccaaaaagccgctcgtagttcggattgcaggctgcaactcgcctgcatgaagccggaattgctagtaatcgcggatcagcatgccgcggtgaatacgttcccgggccttgtacacaccgcccgtcacaccacgagagtcggcaacacccgaagtcggtgaggtaaccccttatggggagccagccgccgaaggtggggtcgatgattggggtgaagtcgtaacaaggtagccgtaccggaaggtgcggctggatcacctcctttctagggag

SEQ ID NO: 1282 - DNA, 1549 bp, Alicyclobacillus shizuokensis
  ref <308>: DATABASE ACCESSION NUMBER: NCBI ACCESSION: NZ_BCQV01000083.1
  ref <309>: DATABASE ENTRY DATE: 2019-04-01
  ref <313>: RELEVANT RESIDUES IN SEQ ID NO: (1)..(1549)
gagagtttgatcctggctcaggacgaacgctggcggcgtgcctaatacatgcaagtcgagcgggccttggggggcttgccccctgaggtcagcggcggacgggtgaggaacacgtgggtaatctgcccatcagtcgggaataacactcggaaacgggtgctaaagccggataggcatcctgggggcatccctgggatgggaaaagcggtttacgctgctgatggaggagcccgcggcgcattagctggttggtggggtaagggcccaccaaggcgacgatgcgtagccggcctgagagggtgaacggccacactgggactgagacacggcccagactcctacgggaggcagcagtagggaatcttccgcaatgggcgcaagcctgacggagcaacgccgcgtgagcgaagaaggccttcgggttgtaaagctcagtcaatcgggaagagcgacctggggagggaatgccctgggggagacggtaccgatggaggaagccccggcaaactacgtgccagcagccgcggtaatacgtagggggcgagcgttgtccggaatgactgggcgtaaagggtgcgtaggcggcctgacacgtctggggtgaaagaccacggctcaaccgtgggggtgccctggaaacggtgaggcttgagtgctggagaggcaaggggaattccacgtgtagcggtgaaatgcgtagagatgtggaggaatacctgtggcgaaggcgccttgctggacagtgactgacgctgaggcacgaaagcgtggggagcgaacaggattagataccctggtagtccacgccgtaaacgatgagtgctaggtgttgggggtgcgagccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgcgtgcagagatgtgcgttcccgtttgggcagaggagacaggtggtgcatggttgtcgtcagctcgtgtcgtgagatgttgggttaagtcccgcaacgagcgcaacccttgacctgtgttaccagcgcgtgaaggcggggactcacaggtgactgccggcgcaagccggaggaaggcggggatgacgtcaaatcatcatgcccttgatgtcctgggcgacacacgtgctacaatgggcggtacaacgggatgcgaagccgcgaggtggagcgaatccctgaaagccgttcgtagttcggattgcaggctgcaacccgcctgcatgaagccggaattgctagtaatcgcggatcagcatgccgcggtgaatccgttcccgggccttgtacacaccgcccgtcacaccacgagagtgagcaacacccgaagtcggtgaggcaaccggagacggagccagccgccgaaggtggggcttgcgattggggtgaagtcgtaacaaggtagccgtatcggaaggtgcggctggatcacctcctttctacggaga

SEQ ID NO: 1283 - DNA, 1542 bp, Alicyclobacillus vulcanalis
  ref <308>: DATABASE ACCESSION NUMBER: NCBI ACCESSION: NZ_FTOO01000020.1
  ref <309>: DATABASE ENTRY DATE: 2019-04-01
  ref <313>: RELEVANT RESIDUES IN SEQ ID NO: (1)..(1542)
gattgagagtttgatcctggctcaggacgaacgctggcggcgtgcctaatacatgcaagtcgagcggacctcttcggaggtcagcggcggacgggtgaggaacacgtgggtaatctgcctttcagaccggaataacgcccggaaacgggcgctaatgccggatacgcccgatgggaggcatctcatgtcggggaaagggccaacgggtccgctgagagaggagcccgcggcgcattagctagttggcggggtaacggcccaccaaggcgacgatgcgtagccggcctgagagggtgaacggccacactgggactgagacacggcccagactcctacgggaggcagcagtagggaatcttccgcaatgggcgcaagcctgacggagcaacgccgcgtgagcgaagaaggccttcgggttgtaaagctctgttgctcggggagagcggcgcagggaggggaaagccctgcgcgagacggtaccgagtgaggaagccccggctaactacgtgccagcagccgcggtaaaacgtagggggcgagcgttgtccggaatcactgggcgtaaagggtgcgtaggcggtcgagcaagtctggagtgaaagtccgtggctcaaccatgggatggctctggaaactgcttgacttgagtgctggagaggcaaggggaattccacgtgtagcggtgaaatgcgtagagatgtggaggaataccagtggcgaaggcgccttgctggacagtgactgacgctgaggcacgaaagcgtggggagcaaacaggattagataccctggtagtccacgccgtaaacgatgagtgctaggtgttggggggacacaccccagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacggatgcagagatgcatcttcccttcggggcagaggagacaggtggtgcatggttgtcgtcagctcgtgtcgtgagatgttgggttcagtcccgcaacgagcgcaacccttgacctgtgttaccagcgcgtgagggcggggactcacaggtgactgccggcgtaagtcggaggaaggcggggatgacgtcaaatcatcatgcccctgatgtcctgggcgacacacgtgctacaatgggcggtacaaagggaggcgaagccgcgaggcggagcgaaacccaaaaagccgctcgtagttcggattgcaggctgcaactcgcctgcatgaagccggaattgctagtaatcgcggatcagcatgccgcggtgaatacgttcccgggccttgtacacaccgcccgtcacaccacgagagtcggcaacacccgaagtcggtgaggtaacccgcaagggagccagccgccgaaggtggggtcgatgattggggtgaagtcgtaacaaggtagccgtaccggaaggtgcggctggatcacctcctttctagggag

SEQ ID NO: 1284 - DNA, 1519 bp, Aliiarcobacter faecis
  ref <308>: DATABASE ACCESSION NUMBER: NCBI ACCESSION: NZ_JARS01000021.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacgggctatagcttgctatagttgtcagctaagtggcgcacgggtgagtaatgtataggtaatgtgcctcttactaagggataacaaatggaaacgtttgctaataccttatactccttattaacataagttaataagggaaagatttatcggtaagagattggcctgtattgtatcagttagttggtggggtaatggcctaccaagacaatgacacataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataagaagataatgacggtattatatgaataagcaccggctaactccgtgccagcagccgcggtaatacggggggtgcaagcgttactcggaatcactgggcgtaaagagcatgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacattattgacgctgagatgcgaaagcgtggggagcaaacaggattagataccctggtagtccacgccctaaacgatgtacactagttgttgtgagactagatcttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaatgatttagagatagattagtgtctgcttgcagaaacttgcatacaggtgctgcacggctgtcgtcagctcgtgtcgtgagatgttgggttaagtcccgcaacgagcgcaaccctcgtccttagttgctaacagttcggctgagaactctaaggagactgcctacgcaagtaggaggaaggtgaggatgacgtcaagtcatcatggcccttacgtccagggctacacacgtgctacaatggggtatacaaagagcggcaatacagtgatgtggagcaaatcttataaaatacctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaaatagctaccttccacagtggattcagcgactggggtgaagtcgtaacaaggtaaccgtaggagaacctgcggttggatcacctcctttc

SEQ ID NO: 1285 - DNA, 1501 bp, Aliihoeflea sp. 2WW
  ref <308>: DATABASE ACCESSION NUMBER: NCBI ACCESSION: NZ_AYOD01000070.1
  ref <309>: DATABASE ENTRY DATE: 2019-04-01
  ref <313>: RELEVANT RESIDUES IN SEQ ID NO: (1)..(1501)
ttcaacatgagagtttgatcctggctcagaacgaacgctggcggcaggcttaacacatgcaagtcgagcgcactcttcggagtgagcggcagacgggtgagtaacacgtgggaatctacccatctctacggaacaactccgggaaactggagctaataccgtatacgccctttgggggaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctctcatactggcaatctcgagttcgagagaggtgagtggaattgcgagtgtagaggtgaaattcgtagatattcgcaggaacaccagtggcgaaggcggctcactggctcgatactgacgctgaggtgcgaaagcgtggggagcaaacaggattagataccctggtagtccacgccgtaaacgatggatgctagccgtcgggcagtttactgttcggtggcgcagctaacgcattaagcatcccgcctggggagtacggtcgcaagattaaaactcaaaggaattgacgggggcccgcacaagcggtggagcatgtggtttaattcgaagcaacgcgcagaaccttaccagcccttgacataccggtcgcggttaccagagatggtttccttcagttcggctggaccggatacaggtgctgcatggctgtcgtcagctcgtgtcgtgagatgttgggttaagtcccgcaacgagcgcaaccctcgcccctagttgccatcattcagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgctctctgcaactcgagagcatgaagttggaatcgctagtaatcgcggatcagcatgccgcggtgaatacgttcccgggccttgtacacaccgcccgtcacaccatgggagttggttctacccgaaggcgctgcgccaacccgcaagggaagcaggcgaccacggtagggtcagcgactggggtgaagtcgtaacaaggtagccgtaggggaacctgcggctggatcacctcctttctaaggaagc

SEQ ID NO: 1286 - DNA, 1471 bp, Aliiroseovarius crassostreae
  ref <308>: DATABASE ACCESSION NUMBER: NCBI ACCESSION: NZ_FPBS01000066.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgcacccttcggggtgagcggcggacgggttagtaacgcgtgggaatatacccggtactaaggaatagcctctggaaacggagagtaataccttatacgcccttcgggggaaagatttatcggtatcggattagcccgcgttagattagttagttggtggggtaatggcctaccaagacgacgatctatagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagtatactgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggatcgtggagacactttccttcagttcggctggatcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacggccgtgcgctaacccttcggggaggcagcggaccacggtaggatcagcgactggggtgaagtcgtaacaaggtagccgtaggggaacctgcggctggatcacctcctttcta

SEQ ID NO: 1287 - DNA, 1475 bp, Aliiroseovarius pelagivivens
  ref <308>: DATABASE ACCESSION NUMBER: NCBI ACCESSION: NZ_OMOI01000003.1
  ref <309>: DATABASE ENTRY DATE: 2019-04-01
  ref <313>: RELEVANT RESIDUES IN SEQ ID NO: (1)..(1475)
caacttgagagtttgatcctggctcagaacgaacgctggcggcaggcctaacacatgcaagtcgagcgcagtccttcgggaccgagcggcggacgggttagtaacgcgtgggaatatacccagtactaaggaatagcctctggaaacggagagtaataccttatacgcccttcgggggaaagatttatcggtattggattagcccgcgttagattagatagttggtggggtaacggcctaccaagtcgacgatctatagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactagtcagttaggggtgaaatcccagggctcaaccctggaactgcccttaatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagtatactattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacttgtcgcgatttccagagatggatttcttcagttcggctggacaagatacaggtgctgcatggctgtcgtcagctcgtgtcgtgagatgttcggttaagtccggcaacgagcgcaacccacgtctttagttgccagcagttcggctgggcactctaaagaaactgccggtgataagccggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacggccgtgcgctaacctctttgaggaggcagcggaccacggtaggatcagcgactggggtgaagtcgtaacaaggtagccgtaggggaacctgcggctggatcacctcctttctaa

SEQ ID NO: 1288 - DNA, 1473 bp, Aliiroseovarius sediminilitoris
  ref <308>: DATABASE ACCESSION NUMBER: NCBI ACCESSION: NZ_FOJB01000004.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgctcacttcggtgggagcggcggacgggttagtaacgcgtgggaatatacccagttctaaggaatagcctcgggaaactgagagtaataccttatacgcccttcgggggaaagatttatcggaattggattagcccgcgttagattagatagttggtggggtaatggcctaccaagtcgacgatctatagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggtttagagagatctattccttcagttcggctggatcagtgacaggtgctgcatggctgtcgtcagctcgtgtcgtgagatgttcggttaagtccggcaacgagcgcaacccacatccttagttgccatcagttcggctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacgacgctgcgctaacctctttgaggaggcaggcggccacggtaggatcagcgactggggtgaagtcgtaacaaggtagccgtaggggaacctgcggctggatcacctcctttctaa

SEQ ID NO: 1289 - DNA, 1430 bp, Aliivibrio finisterrensis
  ref <308>: DATABASE ACCESSION NUMBER: NCBI ACCESSION: NZ_SEZK01000108.1
  ref <309>: DATABASE ENTRY DATE: 2019-04-01
  ref <313>: RELEVANT RESIDUES IN SEQ ID NO: (1)..(1430)
ttaattgaagagtttgatcatggctcagattgaacgctggcggcaggcctaacacatgcaagtcgagcggtaacagaaattagcttgctaatttgctgacgagcggcggacgggtgagtaatgcctgggaatatgccttagtgtgggggataactattggaaacgatagctaataccgcataatgtcttcggaccaaagagggggaccttcgggcctctcgcgctaagattagcccaggtgagattagctagttggtgaggtaagagctcaccaaggcgacgatctctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagtagggaggaaggcgttgtcgttaatagcggcttcgtttgacgttacctacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaaccgcatttgaaactggtgaactagagtgctgtagaggggggtagaatttcaggtgtagcggtgaaatgcgtagagatctgaaggaataccagtggcgaaggcggccccctggacagacactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattcgctagagatagcttagtgccttcgggagctctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgcatacagagggctgcaaactagcgatagtaagcgaatcccaaaaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggctgca

SEQ ID NO: 1290 - DNA, 1556 bp, Aliivibrio salmonicida
  ref <308>: DATABASE ACCESSION NUMBER: NCBI ACCESSION: NZ_CP034240.1
  ref <309>: DATABASE ENTRY DATE: 2019-04-01
  ref <313>: RELEVANT RESIDUES IN SEQ ID NO: (1)..(1556)
ttaattgaagagtttgatcatggctcagattgaacgctggcggcaggcctaacacatgcaagtcgagcggtaacagaaagtagcttgctactttgctgacgagcggcggacgggtgagtaatacctgggaatatgccttgatgtgggggataactattggaaacgatagctaataccgcataatgtcttcggaccaaagagggggatcttcggacctctcgcgtcaagattagcccaggtgagattagctagttggtggggtaagagctcaccaaggcgacgatctctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagtcgtgaggaagggtgtgcagttaatagctgtacatcttgacgttagcgacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaaccgcatttgaaactggtgaactagagtgctagtagaggggggtagaatttcaggtgtagcggtgaaatgcgtagagatctgaaggaataccagtggcgaaggcggccccctggacagacactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatctacagaattcgctagagatagcttagtgccttcgggaactgtaagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgcatacagagggctgcaagctagcgatagtgagcgaatcccaaaaagtgcgtcgtagtccggatcggagtctgcaactcgactccgtgaagtcggaatcgctagtaatcgtgaatcagaatgtcacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagccctaggggaacctggggctggatcacctccttaacgatagat

SEQ ID NO: 1291 - DNA, 1569 bp, Aliivibrio sp. EL58
  ref <308>: DATABASE ACCESSION NUMBER: NCBI ACCESSION: NZ_OMPC01000001.1
  ref <309>: DATABASE ENTRY DATE: 2019-04-01
  ref <313>: RELEVANT RESIDUES IN SEQ ID NO: (1)..(1569)
ttaattgaagagtttgatcatggctcagattgaacgctggcggcaggcctaacacatgcaagtcgagcggtaacagaaattagcttgctaatttgctgacgagcggcggacgggtgagtaatgcctgggaatatgccttgatgtgggggataactattggaaacgatagctaataccgcataatgtttttgttcattacgaacaggaaccaaagagggggatcttcggacctctcgcgtcaagattagcccaggtgagattagctagttggtggggtaagagctcaccaaggcgacgatctctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagtcgtgaggaagggtgtgtagttaatagctgcayatcttgacgttagcgacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaaccgcatttgaaactggtgaactagagtgctgtagaggggggtagaatttcaggtgtagcggtgaaatgcgtagagatctgaaggaataccagtggcgaaggcggccccctggacagacactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccacagaagagaccagagatggacttgtgccttcgggaactgtgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgcatacagagggctgcaagctagcgatagtgagcgaatcccaaaaagtgcgtcgtagtccggatcggagtctgcaactcgactccgtgaagtcggaatcgctagtaatcgtgaatcagaatgtcacggtgaatacgttcccgggccttgtacacaccgcccgtcacaccatgggagtgggctgcaaaagaagtgggtagtttaaccttcgggaggacgctcaccactttgtggttcatgactggggtgaagtcgtaacaaggtagccctaggggaacctggggctggatcacctccttaaacgatagat

SEQ ID NO: 1292 - DNA, 1472 bp, Aliterella atlantica
  ref <308>: DATABASE ACCESSION NUMBER: NCBI ACCESSION: NZ_JYON01000056.1
  ref <309>: DATABASE ENTRY DATE: 2019-04-01
  ref <313>: RELEVANT RESIDUES IN SEQ ID NO: (1)..(1472)
gctcaggatgaacgctggcggtatgcttaacacatgcaagtcgaacggatgttttcggacattagtggcggacgggtgagtaacgcgtgagaatctggctctaggtcggggacaacagttggaaacgactgctaataccggatatgccgcaaggtgaaagattaattgcctggagatgagctcgcgtccgattagctagttggtgtggtaagagcgcaccaaggcgacgatcggtagctggtctgagaggacgatcagccacactgggactgagacacggcccagactcctacgggaggcagcagtggggaattttccgcaatgggcgaaagcctgacggagcaataccgcgtgagggaggaaggctcttgggttgtaaacctcttttctgaaggaagaatacaatgacggtacttcaggaatcagcatcggctaactccgtgccagcagccgcggtaatacggaggatgcaagcgttatccggaatgattgggcgtaaagcgtccgcaggtggcaattcaagtctgcggtcaaaggtcgaggctcaacctcgaaaaggccgtggaaactgaatagctagagtgtggtaggggcagagggaattcccagtgtagcggtgaaatgcgtagagattgggaagaacaccggtggcgaaagcgctctgctaggccaagactgacactgagggacgaaagctaggggagcgaatgggattagataccccagtagtcctagccgtaaacgatggatactaggtgtagcttgtatcgacccaagctgtgccgtagctaacgcgttaagtatcccgcctggggagtacgcgcgcaagcgtgaaactcaaaggaattgacgggggcccgcacaagcggtggagtatgtggtttaattcgatgcaacgcgaagaaccttaccaggacttgacatgtcgcgaatctgggtgaaagctcagagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgttctgggctacacacgtactacaatgctacggacaaagggcagcaagacagcgatgtcaagccaatcccataaaccgtggctcagttcagattgcaggctgcaactcgcctgcatgaaggcggaatcgctagtaatcgcaggtcagcactactgcggtgaatacgttcccgggccttgtacacaccgcccgtcacaccatggaagttggccacgcccgaagtcgttaccctaaccacttgtggagggggatgccgaaggcagggctgatgactggggtgaagtcgtaacaaggtagccgtaccggaaggtgtggctggatcacctcctttt

SEQ ID NO: 1293 - DNA, 1115 bp, Alkalibacter saccharofermentans
  ref <308>: DATABASE ACCESSION NUMBER: NCBI ACCESSION: NZ_FQTU01000034.1
  ref <309>: DATABASE ENTRY DATE: 2019-04-01
  ref <313>: RELEVANT RESIDUES IN SEQ ID NO: (1)..(1115)
tttataatagagagtttgatcctggctcaggacgaacgctggcggcgtgcctaacacatgcaagtcgaacgtgatcttcagagtagtttactacactgaagtgaaagtggcggacgggtgagtaacgcgtgggtaacctggcctatggaaggggatagcctcgggaaaccgggattaataccgtatgtagttgagatgtcgcatgacatatcaatgaaagatttatcgccataggatggacccgcgtcccattagctagttggtgagataacagctcaccaaggcgacgatgggtagccggcctgagagggcggacggccacactgggactgagacacggcccagactcctacgggaggcagcagtggggaatattgcgcaatgggggcaaccctgacgcagcaacgccgcgtgaatgatgaaggtcttcggatcgtaaagttctgtcaaaggggaagaaaaaaatgacggtacccttagaggaagccccggctaactacgtgccagcagccgcggtaatacgtagggggcaagcgttgtccggaattactgggcgtaaagggcgtgtaggcggttttttaagtcagatgtgaaagttcggggctcaacctcggaattgcatttgaaactggagaacttgagtactggagaggtaagtggaattcctagtgtagcggtgaaatgcgtagatattaggaggaacaccagtggcgaaggcgacttactggacagatactgacgctgaggcgcgaaagcgtggggagcgaacaggattagataccctggtagtccacgccgtaaacgatgagtgctaggtgttggggcaactcagtgccgtagttaacacaataagcactccgcctggggagtacgatcgcaagattgaaactcaaaggaattgacgggggcccgcacaagcagcggagcatgtggtttaattcgaagcaacgcgaagaaccttaccaggtcttgacatttcctgatgatcgcagagatgcgaagttcccttcggggacaggaggacaggtggtgcatggttgtcgtcagctcgtgtcgtgagatgttgggttaagtcccgcaacgagcgcaacccttgtatttagttgccagcaggt

SEQ ID NO: 1294 - DNA, 1313 bp, Alkalibacterium gilvum
  ref <308>: DATABASE ACCESSION NUMBER: NCBI ACCESSION: NZ_FNYW01000085.1
  ref <309>: DATABASE ENTRY DATE: 2019-04-01
  ref <313>: RELEVANT RESIDUES IN SEQ ID NO: (1)..(1313)
taacattcggaaacggatgctaataccgcataggtgattttagcgcatgctttaatcattaaagatggcttcggctatcgcttatggatggccccgcggcgtattagctagttggtaaggtaatggcttaccaaggcattgatacgtagccgacctgagagggtgatcggccacactgggactgagacacggcccagactcctacgggaggcagcagtagggaatcttccacaatgggcgaaagcctgatggagcaatgccgcgtgagtgaagaaggtcttcggatcgtaaagctctgttatcggagaagaacacggagtacagtaactggtattccgctgacggtatccgaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggatggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcgaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccagatcttgacatcctctgaccacccaagaaattgggctttcccttcggggacagagtgacaggtggtgcatggttgtcgtcagctcgtgtcgtgagatgttgggttaagtcccgtaacgagcgcaacccttattgttagttgccagcatttagttgggcactctagcgagactgccggtgataaaccggaggaaggcggggatgacgtcaaatcatcatgccccttatgatctgggctacacacgtgctacaatggatggtacaacgagttgcgagaccgcgaggtttagctaatctcctaaagccattctcagttcggattgcaggctgcaactcgcctgcatgaagctggaatcgctagtaatcgcgaatcagaacgtcgcggtgaatacgttcccgggtcttgtacacaccgcccgtcacaccacgagagtttggaacacccgaagtcggtcgagtaacccttt

SEQ ID NO: 1295 - DNA, 1557 bp, Alkalibacterium olivapovliticus
  ref <308>: DATABASE ACCESSION NUMBER: NCBI ACCESSION: NZ_PVTO01000054.1
  ref <309>: DATABASE ENTRY DATE: 2019-04-01
  ref <313>: RELEVANT RESIDUES IN SEQ ID NO: (1)..(1557)
aatgagagtttgatcctggctcaggacgaacgctggcggtatgcctaatacatgcaagtcgaacgctgaagcactctgcttgcagagtgtggatgagtggcgaacgggtgagtaacacgtggggaacctgcccataagagggggataacattcggaaacggatgctaataccgcataggtgatgtgagcgcatgctcggatcattaaagatggcttcggctatcgcttatggatggccccgcggcgtattagctagttggtgaggtaatggctcaccaaggctgtgatacgtagccgacctgagagggtgatcggccacactggaactgagacacggtccagactcctacgggaggcagcagtagggaatcttccacaatgggcgaaagcctgatggagcaataccgcgtgagtgaagaaggtcttcggatcgtaaagctctgttgttagagaagaataagaggtgtagtaactggcacctccttgacggtatctaaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggatggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcaaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccagttcttgacatcctctgaccacccaagagattgggctttcccttcggggacagagtgacaggtggtgcatggttgtcgtcagctcgtgtcgtgagatgttgggttaagtcccgtaacgagcgcaacccttattgttagttgccagcattcagttgggcactctagcgagactgccggtgataaaccggaggaaggcggggatgacgtcaaatcatcatgccccttatgaactgggctacacacgtgctacaatggatggtacaacgagttgcgagaccgcgaggtttagctaatctcctaaagccattctcagttcggattgcaggctgcaactcgcctgcatgaagctggaatcgctagtaatcgcggatcagaacgccgcggtgaatacgttcccgggtcttgtacacaccgcccgtcacaccacgagagtttggaacacccgaagtcggtcgagtaacccttttagggagctagccgccgaaggtgggctggatgattggggtgaagtcgtaacaaggtagccgtatcggaaggtgcggctggatcacctcctttctaagga

SEQ ID NO: 1296 - DNA, 1458 bp, Alkalibacterium pelagium
  ref <308>: DATABASE ACCESSION NUMBER: NCBI ACCESSION: NZ_FNZU01000032.1
  ref <309>: DATABASE ENTRY DATE: 2019-04-01
  ref <313>: RELEVANT RESIDUES IN SEQ ID NO: (1)..(1458)
aatgagagtttgatcctggctcaggacgaacgctggcggtatgcctaatacatgcaagtcgaacgctgaagcactctgcttgcagagtgtggatgagtggcgaacgggtgagtaacacgtggggaacctgcccataagagggggataacatccggaaacgggtgctaataccgcataggtgatcatagcgcatgcttagatcattaaagatggcttcggctatcgcttatggatggccccgcggcgtattagctagttggtgaggtaatggctcaccaaggctgtgatacgtagccgacctgagagggtgatcggccacactggaactgagacacggtccagactcctacgggaggcagcagtagggaatcttccacaatgggcgaaagcctgatggagcaataccgcgtgagtgaagaaggtcttcggatcgtaaagctctgttgttagagaagaacaagaggtgtagtaactggcacctccttgacggtatctaaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggagggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcgaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccagatcttgacatcctctgaccacccaagagattgggctttcccttcggggacagagtgacaggtggtgcatggttgtcgtcagctcgtgtcgtgagatgttgggttaagtcccgtaacgagcgcaacccttattgttagttgccagcattcagttgggcactctagcgagactgccggtgataaaccggaggaaggcggggatgacgtcaaatcatcatgccccttatgatctgggctacacacgtgctacaatggatggtacaacgagtcgcgagaccgcgaggttcagctaatctcctaaagccattctcagttcggattgcaggctgcaactcgcctgcatgaagccggaatcgctagtaatcgcggatcagaacgccgcggtgaatacgttcccgggtcttgtacacaccgcccgtcacaccacgagagtttggaacacccgaagtcggtcgagtaacccttt

SEQ ID NO: 1297 - DNA, 214 bp, Alkalibacterium putridalgicola
  ref <308>: DATABASE ACCESSION NUMBER: NCBI ACCESSION: NZ_FOBL01000013.1
  ref <309>: DATABASE ENTRY DATE: 2019-04-01
  ref <313>: RELEVANT RESIDUES IN SEQ ID NO: (1)..(214)
caaaatgagagtttgatcctggctcaggacgaacgctggcggcatgcctaatacatgcaagtcgaacgatgaagcactctgcttgcagagtgcggaagagtggcgaacgggtgagtaacacgtggggaacctgcccataagagggggataacatccggaaacgggtgctaataccgcataggtgatcatagcgcatgcttagatcattaaagat

SEQ ID NO: 1298 - DNA, 1556 bp, Alkalibacterium sp. 20
  ref <308>: DATABASE ACCESSION NUMBER: NCBI ACCESSION: NZ_LSRN01000095.1
  ref <309>: DATABASE ENTRY DATE: 2019-04-01
  ref <313>: RELEVANT RESIDUES IN SEQ ID NO: (1)..(1556)
attgagagtttgatcctggctcaggacgaacgctggcggtatgcctaatacatgcaagtcgaacgctgaagcactctgcttgcagagtgtggatgagtggcgaacgggtgagtaacacgtggggaacctgcccataagagggggataacattcggaaacggatgctaataccgcataggtgattttagcgcatgctttaatcattaaagatggcttcggctatcgcttatggatggccccgcggcgtattagctagttggtaaggtaatggcttaccaaggcatcgatacgtagccgacctgagagggtgatcggccacactgggactgagacacggcccagactcctacgggaggcagcagtagggaatcttccacaatgggcgaaagcctgatggagcaataccgcgtgagtgatgaaggttttcggatcgtaaagctctgttgttagagaagaacacgaggtgtagtaactggcacctccttgacggtatctaaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggagggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcaaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccagatcttgacatcctctgacaacccgagaaatcgggctttcccttcggggacagagtgacaggtggtgcatggttgtcgtcagctcgtgtcgtgagatgttgggttaagtcccgtaacgagcgcaacccttattgttagttgccagcattcagttgggcactctagcgagactgccggtgataaaccggaggaaggcggggatgacgtcaaatcatcatgccccttatgatctgggctacacacgtgctacaatggatggtacaacgagtcgcaaaaccgcaaggtctagccaatctcttaaagccattctcagttcggattgcaggctgcaactcgcctgcatgaagctggaatcgctagtaatcgcgaatcagaacgtcgcggtgaatacgttcccgggtcttgtacacaccgcccgtcacaccacgagagtttgtaacacccgaagtcggtagggtaacccttaggggagccagccgccgaaggtgggatggatgattggggtgaagtcgtaacaaggtagccgtatcggaaggtgcggctggatcacctcctttctaagga

SEQ ID NO: 1299 - DNA, 1556 bp, Alkalibacterium sp. AK22
  ref <308>: DATABASE ACCESSION NUMBER: NCBI ACCESSION: NZ_JANL01000017.1
  ref <309>: DATABASE ENTRY DATE: 2019-04-01
  ref <313>: RELEVANT RESIDUES IN SEQ ID NO: (1)..(1556)
aacgagagtttgatcctggctcaggacgaacgctggcggcatgcctaatacatgcaagtcgaacgccaacacactctgcttgcagagtgtcgaggagtggcgaacgggtgagtaacacgtggagaacctgcccataagagggggataacatccggaaacgggtgctaataccgcataggtgactggagcgcatgctctagtcatgaaagacggcttcggctgtcgcttatggatggctccgcggcgtattagctagttggtgaggtaatggctcaccaaggcagtgatacgtagccgacctgagagggtgatcggccacactgggactgagacacggcccagactcctacgggaggcagcagtagggaatcttccacaatgggcgaaagcctgatggagcaatgccgcgtgagtgaagaaggttttcggatcgtaaagctctgttgttagagaagaataagaggtgtagtaactggcacctccttgacggtatctaaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggagggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcgaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccagttcttgacatcctctgaccacccaagagattgggctttcccttcggggacagagtgacaggtggtgcatggttgtcgtcagctcgtgtcgtgagatgttgggttaagtcccgtaacgagcgcaacccttattgttagttgccagcattcagttgggcactctagcgagactgccggtgataaaccggaggaaggcggggatgacgtcaaatcatcatgccccttatgaactgggctacacacgtgctacaatggatggtacaacgagttgcgagaccgcgaggtttagctaatctcctaaagccattctcagttcggattgcaggctgcaactcgcctgcatgaagctggaatcgctagtaatcgcggatcagaatgccgcggtgaatacgttcccgggtcttgtacacaccgcccgtcacaccacgagagtttggaacacccgaagtcggccgagtaacccttacgggagctagccgcctaaggtgggctggatgattggggtgaagtcgtaacaaggtagccgtatcggaaggtgcggctggatcacctcctttctaagga

SEQ ID NO: 1300 - DNA, 1556 bp, Alkalibacterium subtropicum
  ref <308>: DATABASE ACCESSION NUMBER: NCBI ACCESSION: NZ_FOLT01000030.1
  ref <309>: DATABASE ENTRY DATE: 2019-04-01
  ref <313>: RELEVANT RESIDUES IN SEQ ID NO: (1)..(1556)
tgagagtttgatcctggctcaggacgaacgctggcggcatgcctaatacatgcaagtcgaacgatgaagcactctgcttgcagagtgcggaagagtggcgaacgggtgagtaacacgtggggaacctgcccataagagggggataacatccggaaacggatgctaataccgcataggtgatcagagcgcatgcttcgatcattaaagatggcttcggctatcgcttatggatggccccgcggcgtattagctagttggtaaggtaatggcttaccaaggcagtgatacgtagccgacctgagagggtgatcggccacactgggactgagacacggcccagactcctacgggaggcagcagtagggaatcttccacaatgggcgaaagcctgatggagcaatgccgcgtgagtgaagaaggtcttcggatcgtaaagctctgttgttagagaagaacaagaggtgtagtaactggcacctccttgacggtatctaaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggatggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcgaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccagatcttgacatcctctgaccacccaggaaactgggctttcccttcggggacagagtgacaggtggtgcatggttgtcgtcagctcgtgtcgtgagatgttgggttaagtcccgtaacgagcgcaacccttattgttagttgccagcattcagttgggcactctagcgagactgccggtgataaaccggaggaaggcggggatgacgtcaaatcatcatgccccttatgatctgggctacacacgtgctacaatggatggtacaacgagttgcgagaccgcgaggtttagctaatctcctaaagccattctcagttcggattgcaggctgcaactcgcctgcatgaagctggaatcgctagtaatcgcgaatcagaacgtcgcggtgaatacgttcccgggtcttgtacacaccgcccgtcacaccacgagagtttgtaacacccgaagtcggtagggtaaccctttactgggagccagccgccgaaggtgggatggatgattggggtgaagtcgtaacaaggtagccgtatcggaaggtgcggctggatcacctcctttctaagga

SEQ ID NO: 1301 - DNA, 1486 bp, Alkalibacterium thalassium
  ref <308>: DATABASE ACCESSION NUMBER: NCBI ACCESSION: NZ_FNFK01000116.1
  ref <309>: DATABASE ENTRY DATE: 2019-04-01
  ref <313>: RELEVANT RESIDUES IN SEQ ID NO: (1)..(1486)
cactctgcttgcagagtgtggatgagtggcgaacgggtgagtaacacgtggggaacctgcccataagagggggataacatccggaaacgggtgctaataccgcataggtgatcatagcgcatgcttagatcattaaagatggcttcggctatcgcttatggatggccccgcggcgtattagctagttggtgaggtaatggctcaccaaggctgtgatacgtagccgacctgagagggtgatcggccacactggaactgagacacggtccagactcctacgggaggcagcagtagggaatcttccacaatgggcgaaagcctgatggagcaataccgcgtgagtgaagaaggtcttcggatcgtaaagctctgttgttagagaagaacaagaggtgtagtaactggcacctccttgacggtatctaaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggagggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcgaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccagatcttgacatcctctgaccacccaagagattgggctttcccttcggggacagagtgacaggtggtgcatggttgtcgtcagctcgtgtcgtgagatgttgggttaagtcccgtaacgagcgcaacccttattgttagttgccagcattcagttgggcactctagcgagactgccggtgataaaccggaggaaggcggggatgacgtcaaatcatcatgccccttatgatctgggctacacacgtgctacaatggatggtacaacgagtcgcgagaccgcgaggtttagctaatctcctaaagccattctcagttcggattgcaggctgcaactcgcctgcatgaagccggaatcgctagtaatcgcggatcagaacgccgcggtgaatacgttcccgggtcttgtacacaccgcccgtcacaccacgagagtttggaacacccgaagtcggtcgagtaacccttttagggagctagccgccgaaggtgggctggatgattggggtgaagtcgtaacaaggtagccgtatcggaaggtgcggctggatcacctcctttctaagga

SEQ ID NO: 1302 - DNA, 1575 bp, Alkalicoccus saliphilus
  ref <308>: DATABASE ACCESSION NUMBER: NCBI ACCESSION: NZ_PZJJ01000066.1
  ref <309>: DATABASE ENTRY DATE: 2019-04-01
  ref <313>: RELEVANT RESIDUES IN SEQ ID NO: (1)..(1575)
tttatcggagagtttgatcctggctcaggacgaacgctggcggcgtgcctaatacatgcaagtcgagcgcaggaaaccggcggaacccttcggggggaagccggtggaatgagcggcggacgggtgagtaacacgtgggcaacctgcctttcagaccggaataaccccgggaaaccggggctaatgccggataatcaagcggttcgcatgaaccgcttgtaaaaggggggagttttctcctcccactggaagatgggcccgcggcgcattagcttgttggtggggtaacggcctaccaaggcgacgatgcgtagccgacctgagagggtgatcggccacactggaactgagacacggtccagactcctacgggaggcagcagtagggaatcatccgcaatgggcgaaagcctgacggtgcaacgccgcgtgaacgaagaaggttttcggatcgtaaagttctgttgtgagggaagaacacgtgccggtcgaacaggccggcaccttgacggtacctcacgagaaagccccggctaactacgtgccagcagccgcggtaatacgtagggggcaagcgttgtccggaattattgggcgtaaagcgcacgcaggcggtctcgtaagtctgatgtgaaagcccacggctcaaccgtggagggtcattggaaactgggagacttgagtgtaggagaggaaagtggaattccacgtgtagcggtgaaatgcgtagatatgtggaggaacaccagtggcgaaggcgactttctggcctacaactgacgctgaggtgcgaaagcgtggggagcaaacaggattagataccctggtagtccacgccgtaaacgttgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgacgcaacgcgaagaaccttaccaggtcttgacatcctttgcccgctctggagacagagttttccccttcgggggacaaagtgacaggtggtgcatggttgtcgtcagctcgtgtcgtgagatgttgggttaagtcccgcaacgagcgcaacccttgaccttagttgccagcattcagttgggcactctagggtgactgccggtgacaaaccggaggaaggtggggacgacgtcaaatcatcatgccccttatgacctgggctacacacgtgctacaatggatggtacaaagggtggcgaagccgcgaggtggagcgaatcccagaaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaacccttacgggggccagccgccgaaggtgggacagatgattggggtgaagtcgtaacaaggtatccgtaccggaaggtgcggatggatcacctcctttcta

SEQ ID NO: 1303 - DNA, 1542 bp, Alkalilimnicola ehrlichii
  ref <308>: DATABASE ACCESSION NUMBER: NCBI ACCESSION: NZ_NFZV01000070.1
  ref <309>: DATABASE ENTRY DATE: 2019-04-01
  ref <313>: RELEVANT RESIDUES IN SEQ ID NO: (1)..(1542)
gaactgaagagtttgatcctggctcagattgaacgctggcggcatgcttaacacatgcaagtcgaacggtaacaggcccttcggggtgctgacgagtggcggacgggtgagtaacgcgtgggaatctgccctttggtgggggacaacccggggaaactcgggctaataccgcataagccttaagagggaaagtgggcctctgattcaagctcacgccgaaggatgagcccgcgtccgattagctagttggtggggtaacggcctaccaaggcgacgatcggtagctggtctgagaggatgatcagccacactgggactgagacacggcccagactcctacgggaggcagcagtggggaatattggacaatgggcgcaagcctgatccagcaatgccgcgtgtgtgaagaaggcctgcgggttgtaaagcactttcagtcgggaggaaaagcgcgaggttaatacccttgtgtgttgacgttaccgacagaagaagcaccggctaactccgtgccagcagccgcggtaatacggagggtgcgagcgttaatcggaattactgggcgtaaagcgcgcgtaggcggtggcgtaagtcgggtgtgaaagccccgggctcaacctgggaattgcattcgatactgcgtcactagagtctggtagagggaagtggaattccgggtgtagcggtgaaatgcgtagatatccggaggaacaccagtggcgaaggcgacttcctggaccaagactgacgctgaggtgcgaaagcgtggggagcaaacaggattagataccctggtagtccacgccgtaaacgatgagaactagccgttggacccattaacgggtttagtggcgcagctaacgcgttaagttctccgcctggggagtacggccgcaaggttaaaactcaaaggaattgacgggggcccgcacaagcggtggagcatgtggtttaattcgatgcaacgcgaagaaccttacctgcccttgacatcctcggaaccctccggagacggaggggtgccttcgggaaccgagtgacaggtgctgcatggctgtcgtcagctcgtgtcgtgagatgttgggttaagtcccgcaacgagcgcaacccttgtccctagttgccagcgattcggtcgggaactctagggagactgccggtgacaaaccggaggaaggtggggacgacgtcaagtcatcatggcccttatgggcagggctacacacgtgctacaatggccggtacagactgttgcgaagccgcgaggtggagctaatcggagaaagccggtcgtagtccggatcggagtctgcaactcgactccgtgaagtcggaatcgctagtaatcgcagatcagcattgctgcggtgaatacgttcccgggccttgtacacaccgcccgtcacaccatgggagtcggctgcaccagaagccggtagcctaaccttcgggagggcgccgtccacggtgtggtcgatgactggggtgaagtcgtaacaaggtagccgtaggggaacctgcggctggatcacctcctttaaa

SEQ ID NO: 1304 - DNA, 1538 bp, Alkaliphilus metalliredigens
  ref <308>: DATABASE ACCESSION NUMBER: NCBI ACCESSION: NC_009633.1
  ref <309>: DATABASE ENTRY DATE: 2019-04-01
  ref <313>: RELEVANT RESIDUES IN SEQ ID NO: (1)..(1538)
tttatatataagagtttgatcctggctcaggatgaacgctggcggcgtgcctaacacatgcaagtcgagcgggttaatctgacggaagccttcgggtggaagaaagtgaaactagcggcggacgggtgagtaacgcgtgggcaacctaccttgtacagggggacaacaacgggaaaccgttgctaataccccataaaaccctagaggggcatcccttaagggtcaaagaatttcggtacaagatgggcccgcgtctgattagctagttggtgaggtaatggctcaccaaggcgacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctaggggaagaatattgacggtaccctaggaggaagccccggctaactacgtgccagcagccgcggtaatacgtagggggcaagcgttatccggaatcactgggcgtaaagggtgcgtaggcggtcttgcaagtcagaggtgaaaggctacggctcaaccgtagtaagcctttgaaactgcaagacttgagtatgggagaggaaagtggaattcctagtgtagcggtgaaatgcgtagatattaggaggaacaccagtggcgaaggcgactttctggaccattactgacgctgaggcacgaaagcgtggggagcaaacaggattagataccctggtagtccacgccgtaaacgatgagtgctaggtgttgggggtcgaacctcagtgccgcagctaacgcattaagcactccgcctggggagtacgctcgcaagagtgaaactcaaaggaattgacggggacccgcacaagcagcggagcatgtggtttaattcgaagcaacgcgaagaaccttacctggacttgacatccctcggaccactccttaaccggagtcttcccttcggggactgaggtgacaggtggtgcatggttgtcgtcagctcgtgtcgtgagatgttgggttaagtcccgcaacgagcgcaacccttgtctttagttgccagcagttcggctgggcactctagagagactgccggggataactcggaggaaggtggggatgacgtcaaatcatcatgccccttatgttcagggctacacacgtgctacaatggccgatacaacgggcagcgaaggagtaatccggagcaaatcctataaagtcggtcccagttcggattgtgggctgaaactcgcccacatgaagctggagttgctagtaatcgcgaatcagaatgtcgcggtgaatgcgttcccgggtcttgtacacaccgcccgtcacaccacgggagtcggaagcacccgaagtcagctatctaaccgtaaggaggaagctgccgaaggtgaagtcgatgactggggtgaagtcgtaacaaggtagccgtatcggaaggtgcggctggatcacctcctttctaagga

SEQ ID NO: 1305 - DNA, 1215 bp, Alkaliphilus transvaalensis
  ref <308>: DATABASE ACCESSION NUMBER: NCBI ACCESSION: NZ_JHYF01000043.1
  ref <309>: DATABASE ENTRY DATE: 2019-04-01
  ref <313>: RELEVANT RESIDUES IN SEQ ID NO: (1)..(1215)
gatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctaagggaagaattttgacggtaccttaggaggaagccccggctaactacgtgccagcagccgcggtaatacgtagggggcaagcgttatccggaatcactgggcgtaaagggtgcgtaggcggtcttacaagtcaggggtgaaaggctacggctcaaccgtagtaagcctttgaaactgtaggacttgagtgcaggagaggaaagtggaattcctagtgtagcggtgaaatgcgtagatattaggaggaacaccagtggcgaaggcgactttctggactgtaactgacgctgaggcacgaaagtgtggggagcaaacaggattagataccctggtagtccacaccgtaaacgatgagtgctaggtgttgggggtcgaacctcagtgccgcagctaacgcattaagcactccgcctggggagtacgctcgcaagagtgaaactcaaaggaattgacggggacccgcacaagcagcggagcatgtggtttaattcgaagcaacgcgaagaaccttacctggacttgacatccttcagaccactccttaaccggagtcttcccttcggggactgaagtgacaggtggtgcatggttgtcgtcagctcgtgtcgtgagatgttgggttaagtcccgcaacgagcgcaacccttgtctttagttgccagcaagtaatgttgggcactctagagagactgccggggataactcggaggaaggtggggatgacgtcaaatcatcatgccccttatgttcagggctacacacgtgctacaatggccgatacaaagggctgcgaaggagtaatctggagccaatcccataaagtcggtcccagttcggattgtgggctgaaactcgcccacatgaagttggagttgctagtaatcgcgaatcagaatgtcgcggtgaatgcgttcccgggtcttgtacacaccgcccgtcacaccatgggagtcggaagcgcccgaagccagctatctaaccttttggaggaagctgtcgaaggtgaagtcgatgactggggtgaagtcgtaacaaggtagccgtatcggaaggtgcggctggatcacctcctttct

SEQ ID NO: 1306 - DNA, 1554 bp, Alkalispirillum mobile
  ref <308>: DATABASE ACCESSION NUMBER: NCBI ACCESSION: NZ_RCDA01000001.1
  ref <309>: DATABASE ENTRY DATE: 2019-04-01
  ref <313>: RELEVANT RESIDUES IN SEQ ID NO: (1)..(1554)
gcaagattgaactgaagagtttgatcctggctcagattgaacgctggcggcatgcctaacacatgcaagtcgagcggcagcagcaggagcttgctcctggctggcgagcggcggacgggtgagtaacgcgtgggaatctgcccttcggtgggggatagcccggggaaactcggattaataccgcatacgccctacggggcaaagtggccctctgattcaaggtcacgccgaaggatgagcccgcgtccgattagctagttggtggggtaaaggcctaccaaggcgacgatcggtagctggtttgagaggatgatcagccacactgggactgagacacggcccagactcctacgggaggcagcagtggggaatattggacaatgggcgaaagcctgatccagcaatgccgcgtgtgtgaagaaggcctgcgggttgtaaagcactttcagcagggaggaaaagcttacggttaatacccgtgagtcttgacgttacctgcagaagaagcaccggctaactccgtgccagcagccgcggtaatacggagggtgcgagcgttaatcggaattactgggcgtaaagcgcgcgtaggcggttcgataagtcgggtgtgaaagccccgggctcaacctgggaattgcatccgatactgtcgggctagagtctggtagagggaagtggaattccgggtgtagcggtgaaatgcgtagatatccggaggaacaccagtggcgaaggcgacttcctggaccaagactgacgctgaggtgcgaaagcgtgggtagcaaacaggattagataccctggtagtccacgccgtaaacgatgagaactagccgttgggctcatttatgggcttagtggcgcagctaacgcattaagttctccgcctggggagtacggccgcaaggttaaaactcaaaggaattgacgggggcccgcacaagcggtggagcatgtggtttaattcgatgcaacgcgaagaaccttacctgcccttgacatcctcggaaccagccagagatggctgggtgccttcgggaaccgagtgacaggtgctgcatggctgtcgtcagctcgtgtcgtgagatgttgggttaagtcccgcaacgagcgcaacccttgtccctagttgccagcgattcggtcgggaactctagggagactgccggtgacaaaccggaggaaggtggggatgacgtcaagtcatcatggcccatatgggcagggctacacacgtgctacaatggccggtacagagggttgccaagccgcgaggtggagctaatcccagaaagccggtcgtagtccggatcggagtctgcaactcgactccgtgaagtcggaatcgctagtaatcgcagatcagcaatgctgcggtgaatacgttcccgggccttgtacacaccgcccgtcacaccatgggagttggctgcaccagaagcaggtagtctaaccttcgggagggcgcctgccacggtgtggtcgatgactggggtgaagtcgtaacaaggtagccgtaggggaacctgcggctggatcacctcctttaaa

SEQ ID NO: 1307 - DNA, 1554 bp, Allofustis seminis
  ref <308>: DATABASE ACCESSION NUMBER: NCBI ACCESSION: NZ_KB894090.1
  ref <309>: DATABASE ENTRY DATE: 2019-04-01
  ref <313>: RELEVANT RESIDUES IN SEQ ID NO: (1)..(1554)
aaattgagagtttgatcctggctcaggacgaacgctggcggcatgcctaatacatgcaagtcgaacgatgaactctctgcttgcagagagggatgagtggcggacgggtgagtaacacgtgggaaacctgcccatgagagggggataacatgcggaaacggatgctaataccccatacctttcacaccacgcatgtggtgtaaaagaaagacggcgaagctgtcgctcatggatggtcccgcggcgcattagcttgtaggtggggtaacggcctacctaggcgatgatgcgtagccgacctgagagggtgaccggccacactgggactgagacacggcccagactcctacgggaggcagcagtagggaatcttccacaatgggcgcaagcctgatggagcaatgccgcgtgaatgatgaaggtcttcggattgtaaagttctgttgttagccaagaactcccaccaagtcactactggtggactgacggtagctaaccagaaagccccggctaactacgtgccagcagccgcggtaatacgtagggggcgagcgttgtccggaattattgggcgtaaagggagcgcaggcggtgcgattagtctgatgtgaaagcccacggcttaaccgtggaatggcattggaaactatcgtacttgaattcagaagaggaaagcggaattccatgtgtagtggtgaaatacgtagatatatggaagaacaccagtggcgaaagcggctttctggtctgaaattgacgctgaggctcgaaagcgtggggagcaaacaggattagataccctggtagtccacgccgtaaacgatgagtgctaagtgtcggagggtttccgcccttcggtgctggagttcacgcattaagcactccgcctggggagtacggccgcaaggctgaaactcaaaggaattgacggggacccgcacaagcggtggagcatgtggtttaattcgaagcaacgcgaagaaccttaccagctcttgacatctgatgcataccctagagataggggaagtccttcgggacatcaagacaggtggtgcatggctgtcgtcagctcgtgtcgtgagatgttgggttaagtcccgtaacgagcgcaacccttgtgattagttgccagcattcagttgggcactctaatcagactgccggtgataaatcggaggaaggtggggatgacgtcaagtcatcatgccccttatgagctgggctacacacgtgctacaatggatggaacaacgagtagcgatcccgcaagggtcagcaaatctttcaaaaccattctcagttcggattgcactctgcaactcgagtgcatgaagccggaatcgctagtaatcgcggatcagcatgccgcggtgaatccgttcccgggtcttgtacacaccgcccgtcacaccacgagagttcgtaacacccgaagccggcgaggtaacccgcaagggagccagctgtcgaaggtgggatggatgattggggtgaagtcgtaacaaggtagccgtatcggaaggtgcggctggatcacctcctttctaagga

SEQ ID NO: 1308 - DNA, 1556 bp, Alloiococcus otitis
  ref <308>: DATABASE ACCESSION NUMBER: NCBI ACCESSION: NZ_UFSN01000003.1
  ref <309>: DATABASE ENTRY DATE: 2019-04-01
  ref <313>: RELEVANT RESIDUES IN SEQ ID NO: (1)..(1556)
taaaacgagagtttgatcttggctcaggacgaacgctggcggcatgcctaatacatgcaagtcgaacgccaaatcttcctgcttgcaggaagaggcggagtggcgaacgggtgagtaacacgtgaggaacttgcccataagagggggataacacccggaaacgggtgctaataccgcataggttttcccagtgcatggtgggaaaataaaaggtggctctgctaccgcttatggatagcctcgcggcgcattagctagttggtagggtaaaggcctaccaaggccatgatgcgtagccgacttgagagggtgatcggccacactggaactgagacacggtccagactcctacgggaggcagcagtagggaatcttccacaatgggtgcaagcctgatggagcaatgccgcgtgagtgaagaaggacttcggttcgtaaagctctgttgttggggaagaacacggataggagtcactgcctatcccttgacggtacccaaccagaaagtcacggctaactacgtgccagcagccgcggtaatacgtaggtgacaagcgttgtccggatttattgggcgtaaagcgagcgcaggcggtccggtaagtctgatgtgaaagcccacggctcaaccgtggaacggcattggaaactggcggacttgaatgtagcagaggaaagtggaattccatgtgtagcggtggaatgcgtagatatatggaggaacaccagtggcgaaagcgactttctgggctatgattgacgctgaggctcgaaagcgtggggagcgaacaggattagataccctggtagtccacgccgtaaacgatgagtgctaagtgttggagggtttccgcccttcagtgctggagttaacgcattaagcactccgcctggggattacgaccgcaaggttgaaactcaaaagaattgacggggacccgcacaagcggtggagcatgtggtttaattcgaagcaacgcgaagaaccttaccagctcttgacatcttctgctagcttcagagatgaagggttcccttcggggacggaatgacaggtggtgcatggttgtcgtcagctcgtgtcgtgagatgttgggttaagtcccgtaacgagcgcaacccttattgttagttgccagcattgagttgggcactctagcaagactgccggtgataaaccggaggaaggcggggatgacgtcaaatcatcatgccccttatgagctgggctacacacgtgctacaatggatggtacaacgagtagcgagaccgcgaggtttagctaatctcccaaagccattctcagttcggattgcaggctgcaactcgcctgcatgaagtcggaatcgctagtaatcgcggatcagaatgccgcggtgaattcgttcccgggtcttgtacacaccgcccgtcacaccacgagagtctgaaacacccgaagccggccgggcaaccatttggagccagccgtcgaaggtgggttggatgattggggtgaagtcgtaacaaggtagccgtatcggaaggtgcggctggatcacctcctttctaagga

SEQ ID NO: 1309 - DNA, 1491 bp, Alphaproteobacteria bacterium WS11
  ref <308>: DATABASE ACCESSION NUMBER: NCBI ACCESSION: NZ_CP032509.1
  ref <309>: DATABASE ENTRY DATE: 2019-04-01
  ref <313>: RELEVANT RESIDUES IN SEQ ID NO: (1)..(1491)
tcaacatgagagtttgatcctggctcagaacgaacgctggcggcaggcttaacacatgcaagtcgagcgccccgcaaggggagcggcagacgggtgagtaacgcgtgggaacgtaccttttgctacggaatagctctgggaaactggaattaataccgtatgtgcccttcgggggaaagatttatcggcaaaagatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaacggtgaagataatgacggtaaccgtagaagaagccccggctaacttcgtgccagcagccgcggtaatacgaagggggctagcgttgttcggaattactgggcgtaaagcgcgcgtaggcgggtatttaagtcaggggtgaaatcccagagctcaactctggaactgcctttgatactgggtacctagagtccggaagaggtgagtggaattgcgagtgtagaggtgaaattcgtagatattcgcaggaacaccagtggcgaaggcggctcactggtccggtactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggtttgtggagacacattccttcagttaggctggatcggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagacagtgatgtcgagctaatctccaaaagccatctcagttcggattgcactctgcaactcgggtgcatgaagttggaatcgctagtaatcgcggatcagcatgccgcggtgaatacgttcccgggccttgtacacaccgcccgtcacaccatgggagttggttctacccgaaggcgctgcgctaaccgcaaggaagcaggcgaccacggtagggtcagcgactggggtgaagtcgtaacaaggtagccgtaggggaacctgcggctggatcacctcctttctaag

SEQ ID NO: 1310 - DNA, 1489 bp, Alsobacter sp. SH9
  ref <308>: DATABASE ACCESSION NUMBER: NCBI ACCESSION: NZ_PVZS01000060.1
  ref <309>: DATABASE ENTRY DATE: 2019-04-01
  ref <313>: RELEVANT RESIDUES IN SEQ ID NO: (1)..(1489)
tcaacttgagagtttgatcctggctcagagcgaacgctggcggcaggcttaacacatgcaagtcgagcgccgtagcaatacggagcggcagacgggtgagtaacgcgtgggaacgtgccctttggttcggaataactcagggaaacttgagctaataccggataagccctttttggggaaagatttatcgccgaaggatcggcccgcgtccgattagctagttggcagggtaatggcctaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcggcggggacgataatgacggtacccgcagaagaagccccggctaacttcgtgccagcagccgcggtaatacgaagggggctagcgttgctcggaatcactgggcgtaaagcgcacgtaggcggatctttaagtcaggggtgaaatcccaaggctcaaccttggaactgcctttgatactggggatctcgagtccggaagaggttggtggaactgcgagtgtagaggtgaaattcgtagatattcgcaagaacaccagtggcgaaggcggccaactggtccggaactgacgctgaggtgcgaaagcgtggggagcaaacaggattagataccctggtagtccacgccgtaaacgatgaatgccagccgttggggagcttgctcttcagtggcgcagctaacgctttgagcattccgcctggggagtacggtcgcaagattaaaactcaaaggaattgacgggggcccgcacaagcggtggagcatgtggtttaattcgaagcaacgcgcagaaccttaccagcctttgacatgtcctggattgttggcagagatgcctccgtctcttcggagccgggaacacaggtgctgcatggctgtcgtcagctcgtgtcgtgagatgttgggttaagtcccgcaacgagcgcaaccctcgcccctagttgccatcattcagttgggcactctagggggactgccggtgataagccgcgaggaaggtggggatgacgtcaagtcctcatggcccttacgggctgggctacacacgtgctacaatggtggtgacagtgggacgcgaaggcgcgagccggagcaaatctccaaaagccatctcagttcggattgcactctgcaactcgagtgcatgaaggtggaatcgctagtaatcgtggatcagcacgccacggtgaatacgttcccgggccttgtacacaccgcccgtcacaccatgggagttggctttacccgaaggcgtttcgctaaccgcaaggaggcagacgaccacggtagggtcagcgactggggtgaagtcgtaacaaggtagccgtaggggaacctgcggctggatcacctcctttct

SEQ ID NO: 1311 - DNA, 1496 bp, Altererythrobacter atlanticus
  ref <308>: DATABASE ACCESSION NUMBER: NCBI ACCESSION: NZ_CP011452.2
  ref <309>: DATABASE ENTRY DATE: 2019-04-01
  ref <313>: RELEVANT RESIDUES IN SEQ ID NO: (1)..(1496)
caaacttgagagtttgatcctggctcagaacgaacgctggcggcatgcctaacacatgcaagtcgaacgagctcttcggagctagtggcgcacgggtgcgtaacgcgtgggaacctgcccttaggttcggaataactccccgaaaggggtgctaataccggataatgtcttcggaccaaagatttatcgcctttggatgggcccgcgttggattagctagttggtagggtaaaggcctaccaaggcgacgatccatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgcgcgtaggcggctttccaagtcaggggtgaaatcccggggctcaaccccggaactgcccttgaaactggatcgctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcttttgacatcccgatcgcgaatagcagagatgcttttcttcagttcggctggatcggtgacaggtgctgcatggctgtcgtcagctcgtgtcgtgagatgttgggttaagtcccgcaacgagcgcaaccctcgtccttagttgccatcatttagttgggaactctaaggaaaccgccggtgataagccggaggaaggtggggatgacgtcaagtcctcatggcccttacaagctgggctacacacgtgctacaatggcgatgacagtgggcagcgagcacgcgagtgtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaagatggtgcgctaaccttttaggaggcagccagccacggtgggatcagcgactggggtgaagtcgtaacaaggtagccgtaggggaacctgcggctggatcacctcctttctaagga

SEQ ID NO: 1312 - DNA, 1497 bp, Altererythrobacter dongtanensis
  ref <308>: DATABASE ACCESSION NUMBER: NCBI ACCESSION: NZ_CP016591.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaacctgcctttaggttcggaataactccccgaaaggggtgctaataccggataatgtcttcggaccaaagatttatcgcctttagatgggcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcgattcaagtcagaggtgaaagcccggggctcaaccccggaactgcctttgaaactagattgctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcccggtcgcggattagagagatcttttccttcagttcggctggaccggtgacaggtgctgcatggctgtcgtcagctcgtgtcgtgagatgttgggttaagtcccgcaacgagcgcaaccctcgtccttagttgccatcattcagttgggcactttaaggaaactgccggtgataagccggaggaaggtggggatgacgtcaagtcctcatggcccttacaggctgggctacacacgtgctacaatggcggtgacagtgggcagcaaactcgcaagggtgagctaatctccaaaagccgtctcagttcggattgtcctctgcaactcgagggcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 1313 - DNA, 1496 bp, Altererythrobacter epoxidivorans
  ref <308>: DATABASE ACCESSION NUMBER: NCBI ACCESSION: NZ_CP012669.1
  ref <309>: DATABASE ENTRY DATE: 2019-04-01
  ref <313>: RELEVANT RESIDUES IN SEQ ID NO: (1)..(1496)
caaacttgagagtttgatcctggctcagaacgaacgctggcggcatgcctaacacatgcaagtcgaacgagaccttcgggtctagtggcgcacgggtgcgtaacgcgtgggaacctgcccttaggttcggaataacagttagaaatgactgctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcgatccaagtcaggggtgaaatcccggggctcaaccccggaactgcccttgaaactaggttgctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgttcgggttcacagaacttgagtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggttagaggagactctttccttcagttcggctggaccagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcgttgacagtgggcagctagaccgcgaggtcatgctaatctctaaaagacgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaagatcgtgcgctaaccttttaggaggcagcgagccacggtgggatcagcgactggggtgaagtcgtaacaaggtagccgtaggggaacctgcggctggatcacctcctttctaagga

SEQ ID NO: 1314 - DNA, 1021 bp, Altererythrobacter flavus
  ref <308>: DATABASE ACCESSION NUMBER: NCBI ACCESSION: NZ_PHSO01000002.1
  ref <309>: DATABASE ENTRY DATE: 2019-04-01
  ref <313>: RELEVANT RESIDUES IN SEQ ID NO: (1)..(1021)
gtaatacggagggagctagcgttgttcggaattactgggcgtaaagcgcacgtaggcggcttttcaagtcaggggtgaaatcccggggctcaaccccggaactgcccttgaaactggatggctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggattagagagatcttttccttcagttcggctggaccagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggcgatgacagtgggcagctatcccgcaagggtgagctaatctccaaaagtcgtctcagttcggattgtcctctgcaactcgagggcatgaaggcggaatcgctagtaatcgcggatcagcatgccgcggtgaatacgttcccaggccttgtacacaccgcccgtcacaccatgggagttggtttcacccgaagatcgtgcgctaaccttttaggaggcagcgagccacggtgggatcagcgactggggtgaagtcgtaacaaggtagccgtaggggaacctgcggctggatcacctcctttctaag

SEQ ID NO: 1315 - DNA, 1496 bp, Altererythrobacter ishigakiensis
  ref <308>: DATABASE ACCESSION NUMBER: NCBI ACCESSION: NZ_CP015963.1
  ref <309>: DATABASE ENTRY DATE: 2019-04-01
  ref <313>: RELEVANT RESIDUES IN SEQ ID NO: (1)..(1496)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggtctattaagtcaggggtgaaatcccggagctcaactccggaactgcccttgaaactggcagactagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcacagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggttagaggagactctttccttcagttcggctggaccagtgacaggtgctgcatggctgtcgtcagctcgtgtcgtgagatgttgggttaagtcccgcaacgagcgcaaccctcgtccttagttgctaccatttagttgggcactttaaggaaactgccggtgataagccggaggaaggtggggatgacgtcaagtcctcatggcccttacaggctgggctacacacgtgctacaatggcgatgacagtgggcagcgaccccgcaagggtgagctaatctccaaaagtcgtctcagttcggattgtcctctgcaactcgagggcatgaaggcggaatcgctagtaatcgcggatcagcatgccgcggtgaatacgttcccaggccttgtacacaccgcccgtcacaccatgggagttggtttcacccgaagatcgtgcgctaaccttttaggaggcagcgagccacggtgggatcagcgactggggtgaagtcgtaacaaggtagccgtaggggaacctgcggctggatcacctcctttctaagga

SEQ ID NO: 1316 - DNA, 1499 bp, Altererythrobacter marensis
  ref <308>: DATABASE ACCESSION NUMBER: NCBI ACCESSION: NZ_LMVG01000003.1
  ref <309>: DATABASE ENTRY DATE: 2019-04-01
  ref <313>: RELEVANT RESIDUES IN SEQ ID NO: (1)..(1499)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataacagttagaaatgactgctaataccggataatgtcttcggaccaaagatttatcgcctttagatgggcccgcgttagattaggtagttggtggggtaatggcctaccaagccgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctattcaagtcaggggtgaaatcccggggctcaaccccggaactgcccttgaaactggatggctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggatagaggagactctttccttcagttcggctggaccagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggcgttgacagtgggcagctagatcgcaagatcatgctaatctctaaaagacgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaaccagtttactggaggcagccaaccacggtgggttcagcgactggggtgaagtcgtaacaaggtagccgtaggggaacctgcggctggatcacctcctttctaagga

SEQ ID NO: 1317 - DNA, 1499 bp, Altererythrobacter namhicola
  ref <308>: DATABASE ACCESSION NUMBER: NCBI ACCESSION: NZ_CP016545.1
  ref <309>: DATABASE ENTRY DATE: 2019-04-01
  ref <313>: RELEVANT RESIDUES IN SEQ ID NO: (1)..(1499)
caaacttgagagtttgatcctggctcagaacgaacgctggcggcatgcctaacacatgcaagtcgaacgaacccttcggggtgagtggcgcacgggtgcgtaacgcgtgggaacctgcccttaggttcggaataacagttggaaacgactgctaataccggataatgtcttcggaccaaagatttatcgcctttggatgggcccgcgtaggattaggtagttggtggggtaaaagcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggcataccaagtcaggggtgaaatcccggggctcaaccccggaactgcccttgaaactggtaagctagaatatcggagaggtaagtggaattccgagtgtagaggtgaaattcgtagatattcggaagaacaccagtggcgaaggcgacttactggacgattattgacgctgaggtgcgaaagcgtggggagcaaacaggattagataccctggtagtccacgccgtaaacgatgataactagctgctcgggctcttagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggattagagagatcttttccttcagttcggctggaccagtgacaggtgctgcatggctgtcgtcagctcgtgtcgtgagatgttgggttaagtcccgcaacgagcgcaaccctcgtccttagttgccatcatttagttgggaactctaaggaaaccgccggtgataagccggaggaaggtggggatgacgtcaagtcctcatggcccttacaggctgggctacacacgtgctacaatggcgatgacagtgagcagcgatcccgcgagggttagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaaccagtttactggaggcagccaaccacggtgggttcagcgactggggtgaagtcgtaacaaggtagccgtaggggaacctgcggctggatcacctcctttctaagga

SEQ ID NO: 1318 - DNA, 1495 bp, Altererythrobacter rigui
  ref <308>: DATABASE ACCESSION NUMBER: NCBI ACCESSION: NZ_RSEL01000028.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacgcgtgggaacctgccttgaggttcggaataacttcccgaaagggatgctaataccggatgatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcgattcaagtcagaggtgaaagcccggggctcaaccccggaactgcctttgaaactagattgctagaatcctggagaggttagtggaattccgagtgtagaggtgaaattcgtagatattcggaagaacaccagtggcgaaggcgactaactggacaggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggattagagagatcttttccttcagttcggctggaccagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcgttgacagtgggcagctagaccgcgaggtcatgctaatctctaaaagacgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggctgtgcgctaacccgcaagggaggcagcagaccacggtgggatcagcgactggggtgaagtcgtaacaaggtagccgtaggggaacctgcggctggatcacctcctttctaag

SEQ ID NO: 1319 - DNA, 1495 bp, Altererythrobacter sp. AY-3R
  ref <308>: DATABASE ACCESSION NUMBER: NCBI ACCESSION: NZ_SDPV01000001.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacgcgtgggaacctgcccttaggttcggaataactccccgaaaggggtgctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggctattcaagtcaggggtgaaatcccggggctcaaccccggaactgcccttgaaactggatggctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggctcatggagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcgggtagaggagactcttcccttcagttcggctggaccagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcgttgacagtgggcagctaggtcgcgagaccatgctaatctctaaaagacgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcgctacgctaacccgcaagggaggcaggcgaccacggtgggatcagcgactggggtgaagtcgtaacaaggtagccgtaggggaacctgcggctggatcacctcctttctaag

SEQ ID NO: 1320 - DNA, 1494 bp, Altererythrobacter sp. B11
  ref <308>: DATABASE ACCESSION NUMBER: NCBI ACCESSION: NZ_AP018498.1
  ref <309>: DATABASE ENTRY DATE: 2019-04-01
  ref <313>: RELEVANT RESIDUES IN SEQ ID NO: (1)..(1494)
caaacatgagagtttgatcctggctcagaacgaacgctggcggcatgcctaacacatgcaagtcgaacgagaccttcgggtctagtggcgcacgggtgcgtaacgcgtgggaacctgcccttaggttcggaataactccccgaaaggggtgctaataccggataatgtcttcggaccaaagatttatcgcctttggatgggcccgcgttggattagctagttggtggggtaaaggcctaccaaggcgacgatccatagctggtcttagaggatgatcagccacactgggactgagacacggcccagactcctacgggaggcagcagtggggaatattggacaatgggggaaaccctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgcacgtaggcggcttggcaagtcaggggtgaaatcccagagctcaactctggaactgcccttgaaactgcttcgctagaatcctggagaggcgagtggaattccgagtgtagaggtgaaattcgtagatattcggaagaacaccagtggcgaaggcgactcgctggacaggaattgacgctgaggtgcgaaagcgtggggagcaaacaggattagataccctggtagtccacgccgtaaacgatgataactagctgtccgggcacatggtgcttgggtggcgcagctaacgcgttaagttatccgcctggggagtacggtcgcaagattaaaactcaaaggaattgacgggggcctgcacaagcggtggagcatgtggtttaattcgaagcaacgcgcagaaccttaccagcttttgacatcccgatcgcgattaccagagatggttttcttcagttcggctggatcggtgacaggtgctgcatggctgtcgtcagctcgtgtcgtgagatgttgggttaagtcccgcaacgagcgcaaccctcgtccttagttgccatcattaagttgggaactctaaggaaaccgccggtgataagccggaggaaggtggggatgacgtcaagtcctcatggcccttacaagctgggctacacacgtgctacaatggcgatgacagtgggcagctatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaagatggtgcgctaaccttttaggaggcagccagccacggtgggatcagcgactggggtgaagtcgtaacaaggtagccgtaggggaacctgcggctggatcacctcctttctaag

SEQ ID NO: 1321 - DNA, 1497 bp, Altererythrobacter sp. BPTF-M16
  ref <308>: DATABASE ACCESSION NUMBER: NCBI ACCESSION: NZ_QURJ01000001.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggataatgtcttcggaccaaagatttatcgcctttagatgggcccgcgttagattagatagttggtggggtaacggcctaccaagtcgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctatccaagtcaggggtgaaatcccggggctcaaccccggaactgcccttgaaactaggtagctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggttagaggagactctttccttcagttcggctggaccagtgacaggtgctgcatggctgtcgtcagctcgtgtcgtgagatgttgggttaagtcccgcaacgagcgcaaccctcgtccttagttgctaccatttagttgggcactttaaggaaactgccggtgataagccggaggaaggtggggatgacgtcaagtcctcatggcccttacaggctgggctacacacgtgctacaatggcgatgacagtgggcagcgaccccgcaagggtgagctaatctccaaaagtcgtctcagttcggattgtcctctgcaactcgagggcatgaaggcggaatcgctagtaatcgcggatcagcatgccgcggtgaatacgttcccaggccttgtacacaccgcccgtcacaccatgggagttggtttcacccgaaggtagtgcgctaacctgtttacaggaggcagctaaccacggtgggatcagcgactggggtgaagtcgtaacaaggtagccgtaggggaacctgcggctggatcacctcctttctaag

SEQ ID NO: 1322 - DNA, 1495 bp, Altererythrobacter sp. Ery1
  ref <308>: DATABASE ACCESSION NUMBER: NCBI ACCESSION: NZ_QXFK01000018.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacgcgtgggaacctgcccttaggttcggaataactccccgaaaggggtgctaataccggataatgtcttcggaccaaagatttatcgcctttggatgggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggcttatcaagtcaggggtgaaatcccggggctcaaccccggaactgcccttgaaactggttggctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcttttgacatcctggtcgcggattagagagatcttttccttcagttcggctggaccagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaagctgggctacacacgtgctacaatggcgttgacagtgggcagctaggccgcaaggccatgctaatctctaaaagacgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcgctacgctaacccgcaaggggggcaggcgaccacggtgggatcagcgactggggtgaagtcgtaacaaggtagccgtaggggaacctgcggctggatcacctcctttctaag

SEQ ID NO: 1323 - DNA, 1494 bp, Altererythrobacter sp. Ery12
  ref <308>: DATABASE ACCESSION NUMBER: NCBI ACCESSION: NZ_RAHJ01000018.1
  ref <309>: DATABASE ENTRY DATE: 2019-04-01
  ref <313>: RELEVANT RESIDUES IN SEQ ID NO: (1)..(1494)
caaacttgagagtttgatcctggctcagaacgaacgctggcggcatgcctaacacatgcaagtcgaacgatcacttcggtgatagtggcgcacgggtgcgtaacgcgtgggaacctgcccttaggttcggaataactcagagaaatttgagctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcttttcaagtcaggggtgaaatcccggggctcaaccccggaactgcccttgaaactggatggctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggattagagagatcttttccttcagttcggctggaccagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggcgatgacagtgggcagctatcccgcaagggtgagctaatctccaaaagtcgtctcagttcggattgtcctctgcaactcgagggcatgaaggcggaatcgctagtaatcgcggatcagcatgccgcggtgaatacgttcccaggccttgtacacaccgcccgtcacaccatgggagttggtttcacccgaagatcgtgcgctaaccttttaggaggcagcgagccacggtgggatcagcgactggggtgaagtcgtaacaaggtagccgtaggggaacctgcggctggatcacctcctttctaag

SEQ ID NO: 1324 - DNA, 1494 bp, Altererythrobacter sp. FM1; identical to SEQ ID NO: 1323
  ref <308>: DATABASE ACCESSION NUMBER: NCBI ACCESSION: NZ_RHHA01000001.1
  ref <309>: DATABASE ENTRY DATE: 2019-04-01
  ref <313>: RELEVANT RESIDUES IN SEQ ID NO: (1)..(1494)

SEQ ID NO: 1325 - DNA, 1495 bp, Altererythrobacter sp. HN-Y73
  ref <308>: DATABASE ACCESSION NUMBER: NCBI ACCESSION: NZ_RAPF01000024.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaagtcttcggacttagtggcgcacgggtgcgtaacgcgtgggaacctgcccttaggttcggaataacagttagaaatgactgctaataccggataatgtcttcggaccaaagatttatcgcctttggatgggcccgcgttagattaggtagttggtggggtaaaggcctaccaagccgacgatctatagctggtctgagaggatgatcagccacactgggactgagacacggcccagactcctacgggaggcagcagtggggaatattggacaatgggggaaaccctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggtttaccaagtcaggggtgaaatcccggggctcaaccccggaactgcccttgaaactggtagactagaatcctggagaggcgagtggaattccgagtgtagaggtgaaattcgtagatattcggaagaacaccagtggcgaaggcgactcgctggacaggtattgacgctgaggtgcgaaagtgtggggagcaaacaggattagataccctggtagtccacaccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgattttggttttcagagatggattccttcagttcggctggatcggtgacaggtgctgcatggctgtcgtcagctcgtgtcgtgagatgttgggttaagtcccgcaacgagcgcaaccctcatccttagttgccatcatttagttgggcactctaaggaaactgccggtgataagccggaggaaggtggggatgacgtcaagtcctcatggcccttacacgctgggctacacacgtgctacaatggcggtgacagtgggcagctaacccgcgagggcaagctaatctccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcgctgcgttaacccgcaagggagacaggcgaccacggtgggatcagcgactggggtgaagtcgtaacaaggtagccgtaggggaacctgcggctggatcacctcctttctaag

SEQ ID NO: 1326 - DNA, 1497 bp, Altererythrobacter sp. MH-B5
  ref <308>: DATABASE ACCESSION NUMBER: NCBI ACCESSION: NZ_JRQQ01000016.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaacctgcctttaggttcggaataacacagagaaatttgtgctaataccggatgatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggtttatcaagtcaggggtgaaatcccggagctcaactccggaactgcccttgaaactggttgactagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgatcgcgattagaggagactcttttcttcagttcggctggatcggtgacaggtgctgcatggctgtcgtcagctcgtgtcgtgagatgttgggttaagtcccgcaacgagcgcaaccctcgtccttagttgccagcattcagttgggcactctaaggaaaccgccggtgataagccggaggaaggtggggatgacgtcaagtcctcatggcccttacacgctgggctacacacgtgctacaatggcggtgacagtgggcagcgaactcgcgagagtgagctaatctccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcgctacgctaacccgcaagggaggcaggcgaccacggtgggatcagcgactggggtgaagtcgtaacaaggtagccgtaggggaacctgcggctggatcacctcctttctaagga

SEQ ID NO: 1327 - DNA, 1497 bp, Altererythrobacter sp. NS1
  ref <308>: DATABASE ACCESSION NUMBER: NCBI ACCESSION: NZ_CP032570.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgccctcttcggagggagtggcgcacgggtgcgtaacgcgtgggaacctgcccttaggttcggaataactcagagaaatttgagctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcgattcaagtcaggggtgaaatcccggggctcaaccccggaactgcctctgaaactagattgctagaatcctggagaggttagtggaattccgagtgtagaggtgaaattcgtagatattcggaagaacaccagtggcgaaggcgactaactggacaggtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcccggtcgcggattagagagatcttttccttcagttcggctggaccggtgacaggtgctgcatggctgtcgtcagctcgtgtcgtgagatgttgggttaagtcccgcaacgagcgcaaccctcgtccttagttgccatcattcagttgggcactttaaggaaactgccggtgataagccggaggaaggtggggatgacgtcaagtcctcatggcccttacaggctgggctacacacgtgctacaatggcggtgacagtgggcagcaaactcgcgagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaaccagtttactggaggcaggcgaccacggtgggcttagcgactggggtgaagtcgtaacaaggtagccgtaggggaacctgcggctggatcacctcctttctaag

SEQ ID NO: 1328 - DNA, 1497 bp, Altererythrobacter sp. Root672
  ref <308>: DATABASE ACCESSION NUMBER: NCBI ACCESSION: NZ_LMHH01000002.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaacctgcctttaggttcggaataactccccgaaaggggtgctaataccgaataatgtcttcggaccaaagatttatcgcctttagatgggcccgcgttggattagctagttggtggggtaaaggcctaccaaggcgacgatccatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgcacgtaggcggcgcagcaagtcaggggtgaaatcccggggctcaacctcggaactgcctctgaaactgcagtgctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcttttgacatcctggtcgcggatagaggagactctttccttcagttcggctggaccagtgacaggtgctgcatggctgtcgtcagctcgtgtcgtgagatgttgggttaagtcccgcaacgagcgcaaccctcgtccttagttgccatcatttagttgggaactctaaggaaaccgccggtgataagccggaggaaggtggggatgacgtcaagtcctcatggcccttacaagctgggctacacacgtgctacaatggcggtgacagtgggcagctatcccgcaagggtgagctaatctccaaaagccgtctcagttcggattgtcctctgcaactcgagggcatgaaggcggaatcgctagtaatcgcggatcagcatgccgcggtgaatacgttcccaggccttgtacacaccgcccgtcacgccatgggagttggtttcacccgaaggtggtgcgctaacccgtaagggaggcagccaaccacggtgggatcagcgactggggtgaagtcgtaacaaggtagccgtaggggaacctgcggctggatcacctcctttctaagga

SEQ ID NO: 1329 - DNA, 1495 bp, Altererythrobacter troitsensis
  ref <308>: DATABASE ACCESSION NUMBER: NCBI ACCESSION: NZ_QTTB01000006.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacgcgtgggaacctgcctttaggttcggaataactcagagaaatttgagctaataccggataatgtcttcggaccaaagatttatcgcctttagatgggcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcgattcaagtcagaggtgaaagcccggggctcaaccccggaactgcctttgaaactagattgctagaatcctggagaggttagtggaattccgagtgtagaggtgaaattcgtagatattcggaagaacaccagtggcgaaggcgactaactggacaggtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggattagagagatcttttccttcagttcggctggaccagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcggtgacagtgggcagcaaactcgcaagggtgagctaatctccaaaagccgtctcagttcggattgtcctctgcaactcgagggcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaag

SEQ ID NO: 1330 - DNA, 1496 bp, Altererythrobacter xiamenensis
  ref <308>: DATABASE ACCESSION NUMBER: NCBI ACCESSION: NZ_FXWG01000001.1
  ref <309>: DATABASE ENTRY DATE: 2019-04-01
  ref <313>: RELEVANT RESIDUES IN SEQ ID NO: (1)..(1496)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataacagtgagaaatcgctgctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggcggaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctatttaagtcaggggtgaaatcccggggctcaaccccggaactgcctttgaaactggatggctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggttcacagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggttagaggagactctttccttcagttcggctggaccagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcggtgacagtgagcagctaactcgcgagagtacgctaatctctaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaagatcgtgcgctaaccttttaggaggcagcgagccacggtgggatcagcgactggggtgaagtcgtaacaaggtagccgtaggggaacctgcggctggatcacctcctttctaagga

SEQ ID NO: 1331 - DNA, 1495 bp, Altererythrobacter xinjiangensis
  ref <308>: DATABASE ACCESSION NUMBER: NCBI ACCESSION: NZ_RSEK01000042.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacgcgtgggaacctgcctttaggttcggaataactccccgaaaggggtgctaataccgaataatgtcttcggaccaaagatttatcgcctttagatgggcccgcgttggattagcttgttggtggggtaatggcctaccaaggcgacgatccatagctggtctgagaggatgatcagccacactgggactgagacacggcccagactcctacgggaggcagcagtggggaatattggacaatgggggaaaccctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggctattcaagtcaggggtgaaatcccggggctcaaccccggaactgcctttgaaactggatggctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcttttgacatcctggtcgcggattagagagatcttttccttcagttcggctggaccagtgacaggtgctgcatggctgtcgtcagctcgtgtcgtgagatgttgggttaagtcccgcaacgagcgcaaccctcgtccttagttgccatcattaagttgggcactctaaggaaaccgccggtgataagccggaggaaggtggggatgacgtcaagtcctcatggcccttacaagctgggctacacacgtgctacaatggcgatgacagtgggcagcaaactcgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcgctgcgctaacccgcaagggaggcaggcgaccacggtgggatcagcgactggggtgaagtcgtaacaaggtagccgtaggggaacctgcggctggatcacctcctttctaag

SEQ ID NO: 1332 - DNA, 1575 bp, Alteribacillus bidgolensis
  ref <308>: DATABASE ACCESSION NUMBER: NCBI ACCESSION: NZ_FNDU01000058.1
  ref <309>: DATABASE ENTRY DATE: 2019-04-01
  ref <313>: RELEVANT RESIDUES IN SEQ ID NO: (1)..(1575)
atttattggagaggtttgatcctggctcaggacgaacgctggcggcgtgcctaatacatgcaagtcgagcgcgggaagcaggcagatcccttcggggtgacgcatgtggaacgagcggcggacgggtgagtaacacgtgggcaacctgccttgcagactgggataaccccgggaaaccggggctaataccggatgatcagccaaatcgcatgatttgattgtaaaagtagggacttgttccttacactgcaagatgggcccgcggcgcattagctagttggtgaggtaagagcttaccaaggcaacgatgcgtagccgacctgagagggtgatcggccacactgggactgagacacggcccagactcctacgggaggcagcagtagggaatcatccgcaatgggcgaaagcctgacggtgcaacgccgcgtgagtgaagaaggttttcggatcgtaaagctctgttatctgggaagaacaagtaccggtcgaataggccggtaccttgacggtacccgatcagaaagccccggctaactacgtgccagcagccgcggtaatacgtagggggcaagcgttgtccggaattattgggcgtaaagggcgcgcaggcggtttcctaagtctgatgtgaaagcccacggctcaaccgtggagggtcattggaaactggggaacttgagtacaggagaggagagcggaattccacgtgtagcggtgaaatgcgtagagatgtggaggaacaccagtggcgaaggcggctctctggcctgtaactgacgctgaggcgcgaaagcgtggggagcgaacaggattagataccctggtagtccacgccgtaaacgttgagtgctaggtgttaggggtttcgacgcccttagtgccgcagcaaacgcattaagcactccgcctggggagtacgaccgcaaggttgaaactcaaaggaattgacgggggcccgcacaagcggtggagcatgtggtttaattcgacgcaacgcgaagaaccttaccaggtcttgacatcttctgccacttccagagatggaaggttccccttcgggggacagaatgacaggtggtgcatggttgtcgtcagctcgtgtcgtgagatgttgggttaagtcccgcaacgagcgcaacccttaaccttagttgccagcattcagttgggcactctagggtgactgccggtgacaaaccggaggaaggtggggatgacgtcaaatcatcatgccccttatgacctgggctacacacgtgctacaatggatggtacagagggacgcgaagccgcgaggtgaagcgaatctcaaaaagccattctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaaccctatgggagccagccgccgaaggtggggcaggtgattggggtgaagtcgtaacaaggtatccctaccggaaggtggggatggatcacctcctttcta

SEQ ID NO: 1333 - DNA, 1571 bp, Alteribacillus iranensis
  ref <308>: DATABASE ACCESSION NUMBER: NCBI ACCESSION: NZ_FONT01000021.1
  ref <309>: DATABASE ENTRY DATE: 2019-04-01
  ref <313>: RELEVANT RESIDUES IN SEQ ID NO: (1)..(1571)
tttatggagagtttgatcctggctcaggacgaacgctggcggcgtgcctaatacatgcaagtcgagcgcgggaagcaggcagatcccttcggggtgacgcctgtggaacgagcggcggacgggtgagtaacacgtgggcaacctgccttagagactgggataaccccgggaaaccggggctaataccggataatcaaaagaatcgcatgattcttttgtaaaagtggggacttgttcctcacactctaagatgggcccgcggcgcattagctagttggggaggtaatggctccccaaggcgacgatgcgtagccgacctgagagggtgaccggccacactgggactgagacacggcccagactcctacgggaggcagcagtagggaatcatccgcaatgggcgaaagcctgacggtgcaacgccgcgtgagtgaagaaggttttcggatcgtaaagctctgttatccgggaagaacaagtgccggtcgaataggccggtgccgtgacggtaccggatcagaaagccccggctaactacgtgccagcagccgcggtaatacgtagggggcaagcgttgtccggaattattgggcgtaaagggcgcgcaggcggtttcctaagtctgatgtgaaagcccacggctcaaccgtggagggtcattggaaactggggaacttgagtacaggagaggagagtggaattccacgtgtagcggtgaaatgcgtagatatgtggaggaacaccagtggcgaaggcggctctctggcctgttactgacgctgaggcgcgaaagcgtgggtagcgaacaggattagataccctggtagtccacgccgtaaacgttgagtgctaggtgttaggggtttcgacgcccttagtgccgaagcaaacgcattaagcactccgcctggggactacgaccgcaaggttgaaactcaaaggaattgacgggggcccgcacaagcggtggagcatgtggtttaattcgacgcaacgcgaagaaccttaccaggtcttgacatcttctgctacttctagagatagaaggttccccttcgggggacagaatgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacagagggaagcgaagccgcgaggtgaagcgaatctcaaaaagccgttctcagttcggattgcaggctgcaactcgcctgcatgaagccggaatcgctagtaatcgtggatcagcatgccacggtgaatacgttcccgggccttgtacacaccgcccgtcacaccacgagagcttgcaacacccgaagtcggtgaggtaacctttgggagccagccgccgaaggtggggcaggtgattggggtgaagtcgtaacaaggtatccctaccggaaggtggggatggatcacctcctttcta

SEQ ID NO: 1334 - DNA, 1291 bp, Alteribacillus persepolensis
  ref <308>: DATABASE ACCESSION NUMBER: NCBI ACCESSION: NZ_FNDK01000065.1
  ref <309>: DATABASE ENTRY DATE: 2019-04-01
  ref <313>: RELEVANT RESIDUES IN SEQ ID NO: (1)..(1291)
ggtaagagctcaccaaggcgacgatgcgtagccgacctgagagggtgatcggccacactgggactgagacacggcccagactcctacgggaggcagcagtagggaatcatccgcaatgggcgaaagcctgacggtgcaacgccgcgtgagtgaagaaggttttcggatcgtaaagctctgttattagggaagaacaagtacagctcgaagagggctgtaccttgacggtacctaatcagaaagccccggctaactacgtgccagcagccgcggtaatacgtagggggcaagcgttgtccggaattattgggcgtaaagggcgcgcaggcggtttcctaagtctgatgtgaaagcccacggctcaaccgtggagggtcattggaaactggggaacttgagtgcaagagaggagagcggaattccacgtgtagcggtgaaatgcgtagagatgtggaggaacaccagtggcgaaggcggctctctggcttgcaactgacgctgaggcgcgaaagcgtggggagcgaacaggattagataccctggtagtccacgccgtaaacgttgagtgctaggtgttaggggtttcgatgcccttagtgccgcagcaaacggcattaagcactccgcctggggagtacgaccgcaaggttgaaactcaaaggaattgacgggggcccgcacaagcggtggagcatgtggtttaattcgacgcaacgcgaagaaccttaccaggtcttgacatcttctgctacttccagagatggaaggttccccttcgggggacagaatgacaggtggtgcatggttgtcgtcagctcgtgtcgtgagatgttgggttaagtcccgcaacgagcgcaacccttgaccttagttgccagcattcagttgggcactctagggtgactgccggtgacaaaccggaggaaggtggggatgacgtcaaatcatcatgccccttatgacctgggctacacacgtgctacaatggatggtacagagggaagcaaaaccgtgaggtcaagcgaatcccaaaaagccattctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaaccttttggagccagccgccgaaggtggggcaggtgattggggtgaagtcgtaacaaggtatccctaccggaaggtggggatggatcacctcctttcta

SEQ ID NO: 1335 - DNA, 1533 bp, Alteromonadaceae bacterium 2052S.S.stab0a.01
  ref <308>: DATABASE ACCESSION NUMBER: NCBI ACCESSION: NZ_RBIO01000001.1
  ref <309>: DATABASE ENTRY DATE: 2019-04-01
  ref <313>: RELEVANT RESIDUES IN SEQ ID NO: (1)..(1533)
taaactgaagagtttgatcatggctcagattgaacgctggcggcaggcctaacacatgcaagtcgagcgtgaaagccttcgggtgagtaaagcggcggacgggtgagtaacgcgtgggaatctgcctagtagtgggggacaacagtcggaaacgactgctaataccgcatacgccctacgggggaaaggaggggatcttcggacctttcgctattagatgagcccgcgtcggattagctagatggtggggtaatggcccaccatggcgacgatccgtagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagtagggaggaaaggttgtacgttaataccgtgcagctatgacgttacctacagaagaagcaccggctaactccgtgccagcagccgcggtaatacggagggtgcaagcgttaatcggaattactgggcgtaaagcgcgcgtaggcggttatttaagctagatgtgaaagccccgggctcaacctgggaactgcatttagaactgggtaactagagtacagcagaggatagtggaatttcaggtgtagcggtgaaatgcgtagagatctgaaggaacatcagtggcgaaggcgactgtctgggctgatactgacgctgaggtgcgaaagcgtggggagcaaacaggattagataccctggtagtccacgccgtaaacgatgtctactagccgttggaacccttgaggttttagtggcgcagctaacgcagtaagtagaccgcctggggagtacggtcgcaagattaaaactcaaatgaattgacgggggcccgcacaagcggtggagcatgtggtttaattcgaagcaacgcgaagaaccttaccaggtcttgacatcctgagaactttcgagagatcgattggtgccttcgggaactcagagacaggtgctgcatggctgtcgtcagctcgtgtcgtgagatgttgggttaagtcccgtaacgagcgcaacccttgtccttagttgccatcagttcggctgggaactctaaggagactgccggtgacaaaccggaggaaggtggggacgacgtcaagtcatcatggcccttacgacctgggctacacacgtgctacaatgggcggtacaaagggttgccaagccgcgaggtggagctaatcccataaaaccgttcgtagtccggattggagtctgcaactcgactccatgaagtcggaatcgctagtaatcgtaaatcagaatgttacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccctaggggaacctggggctggatcacctccttaa

SEQ ID NO: 1336 - DNA, 1539 bp, Alteromonas sp. 76-1
  ref <308>: DATABASE ACCESSION NUMBER: NCBI ACCESSION: NZ_LR136958.1
  ref <309>: DATABASE ENTRY DATE: 2019-04-01
  ref <313>: RELEVANT RESIDUES IN SEQ ID NO: (1)..(1539)
ttaattgaagagtttgatcatggctcagattgaacgctggcggcaggcctaacacatgcaagtcgaacggaaacatatctagcttgctagatgatgtcgagtggcggacgggtgagtaatgcttgggaacttgcctttgcgagggggataacagttggaaacgactgctaataccgcataatgtcttcggaccaaacggggcttaggctccggcgcaaagagaggcccaagtgagattagctagttggtgaggtaaaggctcaccaaggcaacgatctctagctgttctgagaggaagatcagccacactgggactgagacacggcccagactcctacgggaggcagcagtggggaatattgcacaatgggggaaaccctgatgcagccatgccgcgtgtgtgaagaaggccttcgggttgtaaagcactttcagttgtgaggaaaagttagtagttaatacctgctagccgtgacgttaacaacagaagaagcaccggctaactccgtgccagcagccgcggtaatacggagggtgcgagcgttaatcggaattactgggcgtaaagcgcacgcaggcggtttgttaagctagatgtgaaagccccgggctcaacctgggacggtcatttagaactggcagactagagtcttggagaggggagtggaattccaggtgtagcggtgaaatgcgtagatatctggaggaacatcagtggcgaaggcgactccctggccaaagactgacgctcatgtgcgaaagtgtgggtagcgaacaggattagataccctggtagtccacaccgtaaacgctgtctactagctgtttgtgactttaagtcgtgagtagcgaagctaacgcgataagtagaccgcctggggagtacggccgcaaggttaaaactcaaatgaattgacgggggcccgcacaagcggtggagcatgtggtttaattcgatgcaacgcgaagaaccttacctacacttgacatgttgagaagttaccagagatggtttcgtgccttcgggaactcaaacacaggtgctgcatggctgtcgtcagctcgtgtcgtgagatgttgggttaagtcccgcaacgagcgcaacccttgtccttagttgccagcattcagttgggcactctaaggagactgccggtgacaaaccggaggaaggtggggacgacgtcaagtcatcatggcccttacgtgtagggctacacacgtgctacaatggcatatacagagggatgcgagacagtgatgtggagcggaccccttaaagtatgtcgtagtccggattggagtctgcaactcgactccatgaagtcggaatcgctagtaatcgcaggtcagaatactgcggtgaatacgttcccgggccttgtacacaccgcccgtcacaccatgggagtgggatgcaaaagaagtagttagtttaaccttcgggagaacgattaccactttgtgtttcatgactggggtgaagtcgtaacaaggtaaccctaggggaacctggggttggatcacctccttaccaaa

SEQ ID NO: 1337 - DNA, 1545 bp, Alysiella crassa
  ref <308>: DATABASE ACCESSION NUMBER: NCBI ACCESSION: NZ_UFSO01000002.1
  ref <309>: DATABASE ENTRY DATE: 2019-04-01
  ref <313>: RELEVANT RESIDUES IN SEQ ID NO: (1)..(1545)
attgaacataagagtttgatcctggctcagattgaacgctggcggcatgctttacacatgcaagtcgaacggcagcacgggtgcttgcacctggtggcgagtggcgaacgggtgagtaatgcattggaacgtaccgagtagtgggggataactgtccgaaaggatagctaataccgcatacgacctgagggtgaaagcgggggactttttgagcctcgcgctatttgagcggccaatgtctgattaggtagttggtggggtaaaggcctaccaagccgacgatcagtagcgggtctgagaggatgatccgccacactgggactgagacacggcccagactcctacgggaggcagcagtggggaattttggacaatggggggaaccctgatccagccatgccgcgtgtctgaagaaggccttcgggttgtaaaggacttttgtcggggaagaaaagcggattgataataccagttcgtgatgacggtacccgaagaataagcaccggctaactacgtgccagcagccgcggtaatacgtagggtgcgagcgttaatcggaattactgggcgtaaagcgagcgcagacggtttgttaagtcagatgtgaaatccccgagctcaacttgggaacggcgtttgaaactggcaagctagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcaattagctgttggggtacttgataccttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaagagcgtagagatatgcttgtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgaccagggcttcacacgtcatacaatggtcggtacagagggtagccaaaccgcgaggtggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcgaggagcccgcttaccacggtatgtttcatgactggggtgaagtcgtaacaaggtagccgtaggggaacctgcggctggatcacctcctttctag

SEQ ID NO: 1338 - DNA, 1527 bp, Aminiphilus circumscriptus
  ref <308>: DATABASE ACCESSION NUMBER: NCBI ACCESSION: NZ_JAFY01000005.1
  ref <309>: DATABASE ENTRY DATE: 2019-04-01
  ref <313>: RELEVANT RESIDUES IN SEQ ID NO: (1)..(1527)
ctggagagtttgatcctggctcaggacgaacgctggcggcgtgcctaacacatgcaagtcggacgggcatttggtggaagcttgctgaagccggatgttagtggcggacgggtgagtgacgcgtgaggacctatctggaagagggggacaacagttggaaacgactgctaagaccccataagccgagaggtgaaagggagcgatccgcttccggagggactcgcgggctatcagctggttggtggggtaacggcctaccaaggcgaagacggcaagccggcctgagagggcgaccggccacactggaactgagatacggtccagactcctacgggaggcagcagtggggaatattgggcaatgggggcaaccctgacccagcgacgccgcgtggaggaagaagtccctcgggatgtaaactcctgttgtgtgggaagaagcgagtgacggtaccacacgaggaagccccggcaaactacgtgccagcagccgcggtaatacgtagggggcgagcgttgtccggaatcactgggcgtaaagggcacgcaggcggaccgacaggtcgtttgtgaaaggcgagggctcaacccttgtttgcggacgaaaccgtcggactggagtaccggagagggaagtggaattcccggtgtagcggtgaaatgcgtagatatcgggaggaacaccagtggcgaaggcggcttcctggccggatactgacgctcaagtgcgaaagctgggggagcgaacgggattagataccccggtagtcccagccgtaaacgatgaatgctaggtgtgggtgccgtcgggcatccgtgccggagttaacgcgataagcattccgcctggggagtacggtcgcaagactgaaactcaaaggaattgacgggggcccgcacaagcggtggagcacgtggtttaattcgatgcaaaccgaagaaccttacctgggtttgacatgcacgtagtacggaactgaaaggtgaaggaccctcatttcggtgagggagcgtgcacaggtgctgcatggctgtcgtcagctcgtgtcgtgagatgttgggttaagtcccgcaacgagcgcaacccctgcgccgagttgccaacgctacgggcgggaactctcggcggactgccggcgacaagccggaggaaggtggggatgacgtcaagtcatcatggcccttatgtccagggcgacacacgtgctacaatgggcggcacaacgggaagcgaaggggcgaccctgagcggatcctaagaaagccgttcccagttcggattggagtctgcaacccgactccatgaagctggaatcgctagtaatcgcggatcagccaagccgcggtgaatacgttcccgggccttgtacacaccgcccgtcacaccacccgagtcgggtgcacccgaagccggtggcctaaccttttttaagggaggagccgtcgaaggtgtgtctggtgaggggggtgaagtcgtaacaaggtagccgtaccggaaggtgcggctggatcacctcctttctaagga

SEQ ID NO: 1339 - DNA, 1489 bp, Aminobacter aminovorans
  ref <308>: DATABASE ACCESSION NUMBER: NCBI ACCESSION: NZ_UFSM01000001.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccagctctacggaataactcagggaaacttgtgctaataccgtatacgtccgataggagaaagatttatcggagttggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggatcccttcagttcggctggaccggtgacaggtgctgcatggctgtcgtcagctcgtgtcgtgagatgttgggttaagtcccgcaacgagcgcaaccttcgcccttagttgccatcattaagttgggcactctaaggggactgccggtgataagccgcgaggaaggtgaagatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcactgtgctaaccgcaaggaggcaggtgaccacggtagggtcagcgactggggtgaagtcgtaacaaggtagccgtaggggaacctgcggctggatcacctcctttctaag

SEQ ID NO: 1340 - DNA, 1493 bp, Aminobacter sp. AP02
  ref <308>: DATABASE ACCESSION NUMBER: NCBI ACCESSION: NZ_QGGX01000052.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcaggcttaacacatgcaagtcgagcgccccgcaaggggagcggcagacgggtgagtaacgcgtgggaatctacccagctctacggaataactcagggaaacttgtgctaataccgtatacgtccgataggagaaagatttatcggagttggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggatcccttcagttcggctggaccggtgacaggtgctgcatggctgtcgtcagctcgtgtcgtgagatgttgggttaagtcccgcaacgagcgcaaccttcgcccttagttgccatcattcagttgggcactctaaggggactgccggtgataagccgcgaggaaggtgaagatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgccaacctagcaataggaagcaggcgaccacggtagggtcagcgactggggtgaagtcgtaacaaggtagccgtaggggaacctgcggctggatcacctcctttctaag

SEQ ID NO: 1341 - DNA, 1493 bp, Aminobacter sp. J41
  ref <308>: DATABASE ACCESSION NUMBER: NCBI ACCESSION: NZ_JAGL01000083.1
  ref <309>: DATABASE ENTRY DATE: 2019-04-01
  ref <313>: RELEVANT RESIDUES IN SEQ ID NO: (1)..(1493)
ttcaacatgagagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgccctttgggggaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcggtcagttaggggtgaaatcccagggctcaaccctggaactgcctttaatactgccggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagagatggtttccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttgggtttacccgaaggcagtgcgctaaccgcaaggaggcagctgaccacggtaggctcagcgactggggtgaagtcgtaacaaggtagccgtaggggaacctgcggctggatcacctcctttctaagg

SEQ ID NO: 1342 - DNA, 1490 bp, Aminobacter sp. Root100
  ref <308>: DATABASE ACCESSION NUMBER: NCBI ACCESSION: NZ_LMCL01000035.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccagctctacggaataactcagggaaacttgtgctaataccgtatacgtccgataggagaaagatttatcggagttggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctagagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggatcccttcagttcggctggaccggtgacaggtgctgcatggctgtcgtcagctcgtgtcgtgagatgttgggttaagtcccgcaacgagcgcaaccttcgcccttagttgccatcattaagttgggcactctaaggggactgccggtgataagccgcgaggaaggtgaagatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcactgcgctaaccgcaaggaggcaggtgaccacggtagggtcagcgactggggtgaagtcgtaacaaggtagccgtaggggaacctgcggctggatcacctcctttctaagg

SEQ ID NO: 1343 - DNA, 1544 bp, Aminobacterium colombiense
  ref <308>: DATABASE ACCESSION NUMBER: NCBI ACCESSION: NC_014011.1
  ref <309>: DATABASE ENTRY DATE: 2019-04-01
  ref <313>: RELEVANT RESIDUES IN SEQ ID NO: (1)..(1544)
tttatggagagtttgatcctggctcaggacgaacgctggcggcgtgcttaacacatgcaagttgaacgggacggatattgaagcgacttttcggagtggtggatatatttgtttagtagcggacgggtgagtaatgcatgagaacctgcccttcagagggggacaacagttggaaacggctgctaataccccatatgccgagaggtgaaaggagcgatccgctgaaggagtggctcatgtcctatcagctagttggtgaggtaagtgctcaccaaggcgatgacgggtagccggcctgagagggcgaccggccacactggaactgagatacggtccagactcctacgggaggcagcagtggggaatattgggcaatgggcggaagcctgacccagcgacgccgcgtgagggaagaaggcctttgggtcgtaaacctctgttgtatgggaagaaggaagtgacggtaccatacgaggaagtcccggctaactacgtgccagcagccgcggtaatacgtaggggacgagcgttgtccggaattactgggcgtaaagggcgcgcaggcggatatttaagtcagctgttaaagtcatgggctcaactcatggatgcggttgaaactgggtatctagagtgctggagaggtaggcggaattcccggtgtagcggtgaaatgcgtagatatcgggaagaacaccagtggcgaaggcggcttactggccagcaactgacgctgaggcgcgaaagccaggggagcgaacgggattagataccccggtagtcctggccgtaaacgatgaatgctaggtgtgggtgtcgagaggcatccgtgccggagttaacgcgataagcattccgcctggggagtacggtcgcaagattgaaactcaaaggaattgacgggggcccgcacaagcggtggagcacgtggtttaattcgatgcaaaccgaagaaccttacctaggtttgacatgtacgtggtacggatctgaaaggagaaggacctagccttcgggcaaggagcgtacacaggtgctgcatggctgtcgtcagctcgtgtcgtgagatgttgggttaagtcccgcaacgagcgcaacccctgcatccagttaccatcgagtgaagtcggggactctggatggactgccagcgacaagctggaggaaggtggggatgacgtcaagtcatcatggcccttatgcctagggcgacacacgtgctacaatggccgatacagcgggaagctagcctgcgaaggtatgcggatcccacaaagtcggtctcagttcggattgcagtctgcaactcgactgcatgaaggaggaatcgctagtaatcgcggatcagccaagccgcggtgaatacgttcccgggccttgtacacaccgcccgtcacaccacccgagttgggtgcacccgaagccggaggcttaacctttcgaggaaggatccgtctaaggtgtgtctggtgaggggggtgaagtcgtaacaaggtagccgtaccggaaggtgcggctggatcacctcctttctaaggagaaat

SEQ ID NO: 1344 - DNA, 1542 bp, Aminobacterium mobile
  ref <308>: DATABASE ACCESSION NUMBER: NCBI ACCESSION: NZ_JAFZ01000002.1
  ref <309>: DATABASE ENTRY DATE: 2019-04-01
  ref <313>: RELEVANT RESIDUES IN SEQ ID NO: (1)..(1542)
tttttatggagagtttgatcctggctcaggacgaacgctggcggcgtgcttaacacatgcaagttgaacggggcatatatttgacagacttttcggagtttagaagatatatgtttagtagcggacgggtgagtaatgcatgagaacctgtccttcagagggggacaacagctggaaacggttgctaataccccataagccgagaggtgaaaggagtaatccgctggaggaggggctcatgtcctatcagctagttggtaaggtaacggcttaccaaggcgaagacgggtagccggcctgagagggcgaccggccacactggaactgagatacggtccagactcctacgggaggcagcagtggggaatattgggcaatgggcgcaagcctgacccagcgacgccgcgtgagggaagaaggcccttgggtcgtaaacctctgttgtatgggaagaaggacgtgacggtaccatacgaggaagtcccggctaactacgtgccagcagccgcggtaatacgtaggggacgagcgttgtccggaattactgggcgtaaagggcgcgcaggcggatatttaagtcagctgttaaagtcatgggctcaactcatggatgcggttgaaactggatatctcgagtgctggagaggtaggcggaattcccggtgtagcggtgaaatgcgtagatatcgggaagaacaccagtggcgaaggcggcttactggccagcaactgacgctgaggcgcgaaagccaggggagcgaacgggattagataccccggtagtcctggccgtaaacgatgaatgctaggtgtgggtgtcgagaggcatccgtgccggagttaacgcgataagcattccgcctggggagtacggccgcaaggttgaaactcaaaggaattgacgggggcccgcacaagcggtggagcacgtggtttaattcgatgcaaaccgaagaaccttacctgggtttgacatgtacgtagtacggatctgaaaggtgaaggaccgtaccttcgggtacggagcgtacacaggtgctgcatggctgtcgtcagctcgtgtcgtgagatgttgggttaagtcccgcaacgagcgcaacccctgcatccagttaccatcgagtgaagtcggggactctggatggactgccagcgacaagttggaggaaggtggggatgacgtcaagtcatcatggcccttatgtccagggcgacacacgtgctacaatggccgatacagcgggaagcgagcctgcgaaggtaagcggatcccacaaagtcggtctcagttcagattggagtctgcaacccgactccatgaaggaggaatcgctagtaatcgcggatcagccaagccgcggtgaatacgttcccgggccttgtacacaccgcccgtcacaccacccgagttgggtgcacccgaagccggaggctcaacccgtaagggagagattcgtcgaaggtgtgtctggtgaggggggtgaagtcgtaacaaggtagccgtaccggaaggtgcggctggatcacctcctttctaaggag

SEQ ID NO: 1345 - DNA, 1527 bp, Aminomonas paucivorans
  ref <308>: DATABASE ACCESSION NUMBER: NCBI ACCESSION: NZ_CM001022.1
  ref <309>: DATABASE ENTRY DATE: 2019-04-01
  ref <313>: RELEVANT RESIDUES IN SEQ ID NO: (1)..(1527)
cggagagtttgatcctggctcaggacgaacgctggcggcgtgcttaacacatgcaagtcgaacggactgttagtgaaagcttgctggatctaacagttagtggcggacgggtgagtaacacgtgagaacctatcccgacccgggggacaacaggtggaaacgcctgctaataccccataggcgcagagatgcgtgaaaggagcaatccggggagggaggggctcgcggcctatcagctagtaggtggggtaacggcccacctaggcgatgacgggtagccggcctgagagggcgcacggccacactggaactgagacacggtccagactcctacgggaggcagcagtggggaatcttgggcaatgggggcaaccctgacccagcgacgccgcgtgagggacgaaatcccttgggatgtaaacctctgttgtgcgggacgaaggacgtgacggtaccgcacgaggaagccccggcaaactacgtgccagcagccgcggtaatacgtagggggcgagcgttgtccggaattactgggcgtaaagcgcacgcaggcgggttgttaagtcggctgtgaaaagcacgggctcaacctgtgtcttgcggtcgatactggcagcctcgagtacgagagagggaagtggaattcccggtgtagcggtgaaatgcgtagatatcgggaggaacaccagtggcgaaggcggcttcctggctcgtgactgacgctcatgtgcgaaagctgggggagcgaacgggattagataccccggtagtcccagccgtaaacgatggatgctaggtgtgggtatcgtagggtatccgtgccggagttaacgcgataagcatcccgcctggggagtacggccgcaaggctgaaactcaaaggaattgacgggggcccgcacaagcggtggagcacgtggtttaattcgatgcaaaccgaaggaccttacctgggtttgacatgcacgtggtacggagatgaaagtcgaaggaccctggggcaactcagggagcgtgcacaggtgctgcatggctgtcgtcagctcgtgtcgtgagatgttgggttaagtcccgcaacgagcgcaacccctgtggttagttgctaacgggagagccgagcactctagccagactgccgtcgacaagacggaggaaggtggggatgacgtcaagtcatcatggcctttatgcccagggcgacacacgtgctacaatggccggcacagagggcagcaagcgtgcgagcgcaagcgaatcccgtaaagccggtcccagttcggattgcagtctgcaactcgactgcatgaagctggaatcgctagtaatcgcggatcagccaagccgcggtgaatacgttcccgggccttgtacacaccgcccgtcacaccacccgagttgggggtacccgaagtcaccggcctaacccgtaagggaaggaggtgccgaaggtatgcctggtaaggggggtgaagtcgtaacaaggtagccgtaccggaaggtgcggctggatcacctcctttctaagga

SEQ ID NO: 1346 - DNA, 1584 bp, Ammonifex degensii
  ref <308>: DATABASE ACCESSION NUMBER: NCBI ACCESSION: NC_013385.1
  ref <309>: DATABASE ENTRY DATE: 2019-04-01
  ref <313>: RELEVANT RESIDUES IN SEQ ID NO: (1)..(1584)
acggagggtttgatcctggctcaggacgaacgctggcggcgtgcctaacacatgcaagtcgagcgggcttgtcagggccttgtgtcctggcaagttgagcggcggacgggtgagtaacgcgtgggtaacctacccaggagactgggataaccctgggaaactggggctaataccggatacgctcctgctggggcatcctggtgggaggaaaggtggcgttgaggcgctgccgctcctggatgggcccgcgtcccatcagctagttggtggggtaacggcctaccaaggcgacgacgggtagccggcctgagagggtggtcggccacactgggactgagacacggcccagactcctacgggaggcagcagtgggggatcttccgcaatgggcgaaagcctgacggagcgacgccgcgtgggggaagaaggccttcgggtcgtaaacccctgtcgtgggggacgatgctctagggggtgaatagcctcctggggtgacggtacctcacaagaaagccccggctaactacgtgccagcagccgcggtaagacgtagggggcgagcgttgtccggaatcactgggcgtaaagggcgcgtaggcggctccagaagtcgtgggtgaaatccctgggctcaacctaggggctgcccacgaaaccatggggcttgagggcaggagaggggagtggaattcccggtgtagcggtgaaatgcgtagatatcgggaggaacaccagtggcgaaggcggctccctggtctgtccctgacgctgaggcgcgaaagctgggggagcaaaccggattagatacccgggtagtcccagccgtaaacgatgggcgctaggtgtgggggagtgttaactcctccgtgccgtaggtaacccattaagcgccccgcctggggagtacggtcgcaagactgaaactcaaaggaattgacgggggcccgcacaagcggtggagcgcgtggtttaattcgatgctaagcgaagaaccttaccagggcttgacatgctggtggtagcgacccgaaagggaagcgaccccggggtttagccgccggggagccagcacaggtggtgcatggttgtcgtcagctcgtgccgtgaggtgttgggttaagtcccgcaacgagcgcaacccctgcccctagttgccagcgggtgaggccgggcactctagggggactgccgtcgacaagacggaggaaggtggggatgacgtcaaatcatcatgcccctgatgccctgggctacacacgcgctacaatggccggtacagcgggaagcgaagccgcgaggcggagcaaatccctgaaagccggtctcagttcggattgcaggctgcaactcgcctgcatgaagccggaatcgctagtaatcgccggtcagcatacggcggtgaatacgttcccgggccttgtacacaccgcccgtcacaccacggaagccggcaacacccgaagtcggtactcctaaccctcgcaagagggagggagccgccgaaggtggggccggtgactggggtgaagtcgtaacaaggtagccgtacgggaacgtgcggctggatcacctcctttctaagga

SEQ ID NO: 1347 - DNA, 1580 bp, Ammonifex thiophilus
  ref <308>: DATABASE ACCESSION NUMBER: NCBI ACCESSION: NZ_QSLN01000039.1
  ref <309>: DATABASE ENTRY DATE: 2019-04-01
  ref <313>: RELEVANT RESIDUES IN SEQ ID NO: (1)..(1580)
ggagggtttgatcctggctcaggacgaacgctggcggcgtgcctaacacatgcaagtcgagcgggcttgtcggggccttgtgtcccggcaagttgagcggcggacgggtgagtaacgcgtgggtaacctacccgggagactgggataaccctgggaaactggggctaataccggatacgctcctgctggggcatcctggtgggaggaaaggtggcggtcaaagccgctgccgctcctggatgggcccgcgtcccatcagctagttggtggggtaacggcctaccaaggcgacgacgggtagccggcctgagagggtggtcggccacactgggactgagacacggcccagactcctacgggaggcagcagtgggggatcttccgcaatgggcgaaagcctgacggagcgacgccgcgtgggggaagaaggccttcgggtcgtaaacccctgtcgtgggggaagatgcctcagggggtgaacagcttcttggggtgacggtaccccacaagaaagccccggctaactacgtgccagcagccgcggtaagacgtagggggcgagcgttgtccggaatcactgggcgtaaagggcgcgtaggcggcctcagaagtcgtgggtgaaatctccaggctcaacctgggggctgcccacgaaaccatggggcttgagggcaggagaggggagtggaattcccggtgtagcggtgaaatgcgtagatatcgggaggaacaccagtggcgaaggcggctccctggtctgtccctgacgctgaggcgcgaaagctgggggagcaaaccggattagatacccgggtagtcccagccgtaaacgatgggcgctaggtgtgggggagtgttaactcctccgtgccgcaggtaacccattaagcgccccgcctggggagtacggtcgcaagactgaaactcaaaggaattgacgggggcccgcacaagcggtggagcgcgtggtttaattcgatgctaagcgaagaaccttaccagggcttgacatgctggtggtagtgacccgaaaggggagcgaccccggggtttagccgccggggagccagcacaggtggtgcatggttgtcgtcagctcgtgccgtgaggtgttgggttaagtcccgcaacgagcgcaacccctgcccctagttgccagcgggtaaggccgggcactctagggggactgccgtcgacaagacggaggaaggtggggatgacgtcaaatcatcatgcccctgatgccctgggctacacacgcgctacaatggccggtacagcgggaagcgaagccgcgaggcggagcaaatccctgaaagccggtctcagttcggattgcaggctgcaactcgcctgcatgaagccggaatcgctagtaatcgccggtcagcatacggcggtgaatacgttcccgggccttgtacacaccgcccgtcacaccacggaagccggcaacacccgaagtcggaactcctaaccctcgcgagagggagggagccgccgaaggtggggccggtgactggggtgaagtcgtaacaaggtagccgtacgggaacgtgcggctggatcacctcctttcta

SEQ ID NO: 1348 - DNA, 1526 bp, Amnibacterium sp. DD4a
  ref <308>: DATABASE ACCESSION NUMBER: NCBI ACCESSION: NZ_QXTG01000005.1
  ref <309>: DATABASE ENTRY DATE: 2019-04-01
  ref <313>: RELEVANT RESIDUES IN SEQ ID NO: (1)..(1526)
tttacggagagtttgatcctggctcaggacgaacgctggcggcgtgcttaacacatgcaagtcgaacggtgatgcggagcttgctccgcggatcagtggcgaacgggtgagtaacacgtgagtaacctgccctggactctgggataagcgttggaaacgacgtctaataccggatatgacttcggaacgcatgttctggagtggaaagaatttcggtctgggatggactcgcggcctatcagcttgttggtggggtgatggcctaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttggcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacgcgaggctcaacctcgcgcctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagcgtggggagcgaacaggattagataccctggtagtccacgccgtaaacgttgggaactagatgtggggtccattccacggattccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatgcacctgaaaaggctggaaacagtctcctcgcaagacaggtgcacaggtggtgcatggttgtcgtcagctcgtgtcgtgagatgttgggttaagtcccgcaacgagcgcaaccctcgttctatgttgccagcgcgtcatggcgggaactcataggagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcccaaccgttgtggagggagccgtcgaaggtgggatcggtaattaggactaagtcgtaacaaggtagccgtaccggaaggtgcggctggatcacctcctttctaagga

SEQ ID NO: 1349 - DNA, 1526 bp, Amnibacterium sp. M8JJ-5
  ref <308>: DATABASE ACCESSION NUMBER: NCBI ACCESSION: NZ_QEOP01000007.1
  ref <309>: DATABASE ENTRY DATE: 2019-04-01
  ref <313>: RELEVANT RESIDUES IN SEQ ID NO: (1)..(1526)
tctacggagagtttgatcctggctcaggacgaacgctggcggcgtgcttaacacatgcaagtcgaacggtgaagcagagcttgctctgcggatcagtggcgaacgggtgagtaacacgtgagtaacctgcccttgactctgggataagcgttggaaacgacgtctaataccggatacgacctacggaggcatctcctgtgggtggaaagaattttggtcaaggatggactcgcggcctatcagctagttggtgaggtaacggcccaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcacgtctgctgtgaaaactggaggctcaacctccagcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtggggtccattccacggattccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacctgaaaaggctggaaacagtctccccgcaaggcaggtatacaggtggtgcatggttgtcgtcagctcgtgtcgtgagatgttgggttaagtcccgcaacgagcgcaaccctcgttctatgttgccagcacgtaatggtgggaactcataggagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttctcgggccttgtacacaccgcccgtcaagtcatgaaagtcggtaacacccgaagccagtggcccaaccgcaaggagggagctgtcgaaggtgggatcggtgattaggactaagtcgtaacaaggtagccgtaccggaaggtgcggctggatcacctcctttctaagga

SEQ ID NO: 1350 - DNA, 1497 bp, Amorphus coralli
  ref <308>: DATABASE ACCESSION NUMBER: NCBI ACCESSION: NZ_KB894580.1
  ref <309>: DATABASE ENTRY DATE: 2019-04-01
  ref <313>: RELEVANT RESIDUES IN SEQ ID NO: (1)..(1497)
tcatcaaacctgagagtttgatcctggctcagaacgaacgctggcggcaggcttaacacatgcaagtcgaacgcactcttcggagtgagtggcagacgggtgagtaacgcgtgggaacctacctggtggttcgggataacctggggaaactcaggctaataccgaataagcccttcgggggaaagatttattgccattggacgggcccgcgtcggattagctagttggtgaggtaacggctcaccaaggctacgatccgtagctggtctaagaggatgatcagccacactgggactgagacacggcccagactcctacgggaggcagcagtggggaatattggacaatgggggcaaccctgatccagccatgccgcgtgagtgatgaaggccttagggttgtaaagctctttcagcggggaagataatgacggtacccgcagaagaagccccggctaacttcgtgccagcagccgcggtaatacgaagggggctagcgttgttcggaattactgggcgtaaagcgcgcgtaggcgggtcgttaagtcaggggtgaaagcccggagctcaactccggaatagcccttgatactggcgatcttgagttcgagagaggtgagtggaactccgagtgtagaggtgaaattcgtagatattcggaagaacaccagtggcgaaggcggctcactggctcgatactgacgctgaggtgcgaaagcgtggggagcaaacaggattagataccctggtagtccacgccgtaaacgatgagtgctagccgtcggacagcatgctgttcggtggcgcagctaacgcattaagcactccgcctggggagtacggtcgcaagattaaaactcaaaggaattgacgggggcccgcacaagcggtggagcatgtggtttaattcgaagcaacgcgcagaaccttaccagctcttgacatgccaggacggttcccggagacgggttcctccacttcggtggcctggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggcggtgacagtgggcagcgacttcgcgaggagtagctaatccccaaaagccgtctcagttcggattgcactctgcaactcgggtgcatgaagttggaatcgctagtaatcgtagaacagcatgctacggtgaatacgttcccgggccttgtacacaccgcccgtcacaccatgggagttggctctacccgaaggcgctgtgctaaccgcaaggaggcaggcgaccacggtagggtcagcgactggggtgaagtcgtaacaaggtagccgtaggggaacctgcggctggatcacctcctttctaagga

SEQ ID NO: 1351 - DNA, 1552 bp, Amphibacillus jilinensis
  ref <308>: DATABASE ACCESSION NUMBER: NCBI ACCESSION: NZ_JH976443.1
  ref <309>: DATABASE ENTRY DATE: 2019-04-01
  ref <313>: RELEVANT RESIDUES IN SEQ ID NO: (1)..(1552)
ggctcaggacgaacgctggcggcgtgcctaatacatgcaagtcgagcgcaggaagcatgacggatcccttcggggtgacatcatgtggaatgagcggcggacgggtgagtaacacgtgggcaacctacctgtaagactgggataactccgggaaaccggagctaataccggataatccttattcctgcatgggaggaaggtaaaaggcggcattatgctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaacacgtaccgatcaaataggtcggtaccttgacggtacctaacgaggaagccccggctaactacgtgccagcagccgcggtaatacgtagggggcaagcgttgtccggaattattgggcgtaaagcgcacgcaggcggttttttaagtctgatgtgaaatcttgcggctcaaccgcaagcggtcattggaaactggagaacttgagtgcagaagaggagagtggaattccacgtgtagcggtgaaatgcgtagagatgtggaggaacaccagtggcgaaggcgactctctggtctgttactgacgctgaggtgcgaaagcgtggggagcaaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatccttatgcccgctctagagatagagttttcccttcggggacataagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaagccgcaaggccaagcgaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttagcaacacccgaagtcggtgaggtaaccatttggagccagccgccgaaggtggggccaatgattggggtgaagtcgtaacaaggtagccgtatcggaaggtgcggctggatcacctcctttctaa

SEQ ID NO: 1352 - DNA, 816 bp, Amphibacillus sediminis
  ref <308>: DATABASE ACCESSION NUMBER: NCBI ACCESSION: NZ_BCQW01000070.1
  ref <309>: DATABASE ENTRY DATE: 2019-04-01
  ref <313>: RELEVANT RESIDUES IN SEQ ID NO: (1)..(816)
tttattgagagtttgatcttggctcaggacgaacgctggcggcgtgcctaatacatgcaagtcgagcgcaggaagctagacagaactcttcggagtgacgtcaagtggaatgagcggcggacgggtgagtaacacgtgggcaacctacctgtaagactgggataactccgggaaaccggagctaataccggataaaatttttcgctgcatggcgaagaaatgaaaggtggcttttagctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaacacgtaccgttcaaatagggcggtaccttgacggtacctaacgagaaagccccggctaactacgtgccagcagccgcggtaatacgtagggggcgagcgttgtccggaattattgggcgtaaagcgcgcgcaggcggttttttaagtctgatgtgaaatcttgcggctcaaccgtaagcggtcattggaaactggagaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacaggattaga

SEQ ID NO: 1353 - DNA, 1575 bp, Amphibacillus xylanus
  ref <308>: DATABASE ACCESSION NUMBER: NCBI ACCESSION: NC_018704.1
  ref <309>: DATABASE ENTRY DATE: 2019-04-01
  ref <313>: RELEVANT RESIDUES IN SEQ ID NO: (1)..(1575)
attttattgagagtttgatcttggctcaggatgaacgctggcggcgtgcctaatacatgcaagtcgagcgcgtgaaattaaacagatctcttcggagtgacgtttaatggatcgagcggcggatgggtgagtaacacgtgggcaacctgcctataagactgggataacttacggaaacgtgagctaataccggataaaaccttttgtctcctgacaagaggataaaagatggcgcaagctatcacttatagatgggcccgcggcgcattagctagttggtgagataaaagctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgaagaaggtcttcggatcgtaaagttctgttgttagggaagaacacgtaccattcgaatagggtggtaccttgacggtacctaacgagaaagccccggctaactacgtgccagcagccgcggtaatacgtagggggcaagcgttgtccggaattattgggcgtaaagcgcgcgcaggcggttctttaagtctgatgtgaaatcttgcggctcaaccgcaagcggtcattggaaactggagaacttgaggacagaagaggagagtggaattccacgtgtagcggtgaaatgcgtagagatgtggaggaacaccagtggcgaaggcgactctctggtctgtaactgacgctgaggcgcgaaagcgtgggtagcgaacaggattagataccctggtagtccacgccgtaaacgatgagtgctaggtgttagggggtttccgccccttagtgctggcgttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcccgctgaccgctatggagacatagctttcccttcggggacagcggtgacaggtggtgcatggttgtcgtcagctcgtgtcgtgagatgttgggttaagtcccgcaacgagcgcaacccttgaacttagttgccagcattcagttgggcactctaagttgactgccggtgacaaaccggaggaaggttgggatgacgtcaaatcatcatgccccttatgacctgggctacacacgtgctacaatggatggtacaaagggctgcgaaaccgcgaggtggagccaatcccataaaaccattttcagttcggattgtaggctgcaactcgcctacatgaagccggaatcgctagtaatcgcggatcagaatgccgcggtgaatacgttcccgggtcttgtacacaccgcccgtcacaccacgagagttagcaacacccgaagtcggtgaggtaacgcttttagcgagccagccgccgaaggtggggccaatgattggggtgaagtcgtaacaaggtagccgtatcggaaggtgcggctggatcacctcctttcta

SEQ ID NO: 1354 - DNA, 1545 bp, Amphritea balenae
  ref <308>: DATABASE ACCESSION NUMBER: NCBI ACCESSION: NZ_RQXV01000023.1
  ref <309>: DATABASE ENTRY DATE: 2019-04-01
  ref <313>: RELEVANT RESIDUES IN SEQ ID NO: (1)..(1545)
taaactgaagagtttgatcatggctcagattgaacgctggcggcaggcctaacacatgcaagtcgagcggtaacatttctagcttgctagaagatgacgagcggcggacgggtgagtaacgcgtagaaatctgcctggtagtgggggatagcccagagaaatttggattaataccgcatacgccctacgggggaaagcaggggaccttcgggccttgcgctatcagatgagtctgcgtcggattagcttgttggtgaggtaatggctcaccaaggcgacgatccgtagctggtctgagaggatgatcagccacactggaactgagacacggtccagactcctacgggaggcagcagtggggaatattgcacaatgggcgcaagcctgatgcagccatgccgcgtgtgtgaagaaggccctagggttgtaaagcactttcagcagtgaggaaaggttggtagttaataactgccagctgtgacgttaactgcagaagaaggaccggctaactccgtgccagcagccgcggtaatacggagggtccaagcgttaatcggaattactgggcgtaaagcgcgcgtaggcggtttgttaagtcagatgtgaaagccctgggctcaacctgggaactgcacctgatactggcaaactagagtacagaagagggtggtggaatttcctgtgtagcggtgaaatgcgtagatataggaaggaacaccagtggcgaaggcgaccacctggtctgatactgacgctgaggtgcgaaagcgtggggagcaaacaggattagataccctggtagtccacgccgtaaacgatgtctactagccgttggggaacttgattccttagtggcgcagctaacgcactaagtagaccgcctggggagtacggccgcaaggttaaaactcaaatgaattgacgggggcccgcacaagcggtggagcatgtggtttaattcgacgcaacgcgaagaaccttacctactcttgaaatccagagaattcgctagagatagcttagtgccttcgggaactctgtgacaggtgctgcatggctgtcgtcagctcgtgttgtgaaatgttgggttaagtcccgtaacgagcgcaacccttgtccttatttgccagcacgtaatggtgggaactctaaggagactgccggtgacaaaccggaggaaggtggggacgacgtcaagtcatcatggcccttacgagtagggctacacacgtgctacaatggccggtacagagggccgcaaacccgcgagggggagcaaatctcagaaaaccggtcgtagtccggattggagtctgcaactcgactccatgaagtcggaatcgctagtaatcgcgaatcagaatgtcgcggtgaatacgttcccgggccttgtacacaccgcccgtcacaccatgggagtggattgcaccagaagtagctagcttaaccttcgggagggcggttaccacggtgtggttcatgactggggtgaagtcgtaacaaggtagccctaggggaacctggggctggatcacctccttaaac

SEQ ID NO: 1355 - DNA, 1542 bp, Amphritea sp. MCCC 1K03512
  ref <308>: DATABASE ACCESSION NUMBER: NCBI ACCESSION: NZ_RQXW01000037.1
  ref <309>: DATABASE ENTRY DATE: 2019-04-01
  ref <313>: RELEVANT RESIDUES IN SEQ ID NO: (1)..(1542)
aaactgaagagtttgatcatggctcagattgaacgctggcggcaggcttaacacatgcaagtcgagcggtaacaggggtagcttgctacccgctgacgagcggcggacgggtgagtaacgcgtagaaatctgcctggtagtgggggatagcccagagaaatttggattaataccgcatacgccctacgggggaaagcaggggaccttcgggccttgcgctatcagatgagtctgcgtcggattagctagttggtgaggtaatggctcaccaaggcgacgatccgtagctggtctgagaggatgatcagccacactggaactgagacacggtccagactcctacgggaggcagcagtggggaatattgcacaatgggcgcaagcctgatgcagccatgccgcgtgtgtgaagaaggccttagggttgtaaagcactttcagcagtgaggaaagggtgtaagttaatagcttgcatctgtgacgttaactgcagaagaaggaccggctaactccgtgccagcagccgcggtaatacggagggtccgagcgttaatcggaattactgggcgtaaagcgcgcgtaggcggtttgttaagtcagatgtgaaagccctgggctcaacctgggaactgcatctgatactggcaaactagagtacagaagagggtggtggaatttcctgtgtagcggtgaaatgcgtagatataggaaggaacatcagtggcgaaggcgaccacctggtctgatactgacgctgaggtgcgaaagcgtggggagcaaacaggattagataccctggtagtccacgccgtaaacgatgtctactagccgttggggaacttgattccttagtggcgcagctaacgcactaagtagaccgcctggggagtacggccgcaaggttaaaactcaaatgaattgacgggggcccgcacaagcggtggagcatgtggtttaattcgacgcaacgcgaagaaccttacctactcttgaaatccagagaattcgctagagatagcttagtgccttcgggaactctgtgacaggtgctgcatggctgtcgtcagctcgtgtcgtgagatgttgggttaagtcccgtaacgagcgcaacccttgtccttatttgccagcacgtaatggtgggaactctaaggagactgccggtgacaaaccggaggaaggtggggacgacgtcaagtcatcatggcccttacgagtagggctacacacgtgctacaatggccggtacagagggccgcaaccccgcgagggtgagcaaatctcagaaaaccggtcgtagtccggattggagtctgcaactcgactccatgaagtcggaatcgctagtaatcgcgaatcagaatgtcgcggtgaatacgttcccgggccttgtacacaccgcccgtcacaccatgggagtggattgcaccagaagtagatagtctaaccttcgggaggacgtttaccacggtgtggttcatgactggggtgaagtcgtaacaaggtagccctaggggaacctggggctggatcacctccttaa

SEQ ID NO: 1356 - DNA, 1525 bp, Amycolatopsis balhimycina
  ref <308>: DATABASE ACCESSION NUMBER: NCBI ACCESSION: NZ_QHHU01000165.1
  ref <309>: DATABASE ENTRY DATE: 2019-04-01
  ref <313>: RELEVANT RESIDUES IN SEQ ID NO: (1)..(1525)
ttgttggagagtttgatcctggctcaggacgaacgctggcggcgtgcttaacacatgcaagtcgaacgctgatccgctttcgggtggtgatgagtggcgaacgggtgagtaacacgtgggtaatctgccctgcactctgggataagccttggaaacggggtctaataccggatatcacaacttctcgcatggggggttgttgaaagttctggcggtgcaggatgaacccgcggcctatcagcttgttggtggggtagtggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcgccagggacgaagcgcaagtgacggtacctggataagaagcaccggctaactacgtgccagcagccgcggtaatacgtagggtgcgagcgttgtccggatttattgggcgtaaagagctcgtaggcggtttgtcgcgtcggccgtgaaatctccacgcttaacgtggagcgtgcggtcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacggtgggtgctaggtgtgggcgacatccacgttgtccgtgccgtagctaacgcattaagcaccccgcctggggagtacggccgcaaggctaaaactcaaaggaattgacgggggcccgcacaagcggcggagcatgtggattaattcgatgcaacgcgaagaaccttacctgggcttgacatgcgccagacatcctcagagatggggcttcccttgtggttggtgtacaggtggtgcatggctgtcgtcagctcgtgtcgtgagatgttgggttaagtcccgcaacgagcgcaacccttatcctacgttgccagcgcgttatggcggggactcgtgggagactgccggggtcaactcggaggaaggtggggatgacgtcaagtcatcatgccccttatgtccagggcttcacacatgctacaatggctggtacagagggctgcgataccgcgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaacctcgtaaggggagggagtggtcgaaggtgggactggcgattgggacgaagtcgtaacaaggtagccgtaccggaaggtgcggctggatcacctcctttctaa

SEQ ID NO: 1357 - DNA, 1524 bp, Amycolatopsis circi
  ref <308>: DATABASE ACCESSION NUMBER: NCBI ACCESSION: NZ_PQIA01000305.1
  ref <309>: DATABASE ENTRY DATE: 2019-04-01
  ref <313>: RELEVANT RESIDUES IN SEQ ID NO: (1)..(1524)
ttgttggagagtttgatcctggctcaggacgaacgctggcggcgtgcttaacacatgcaagtcgaacgctgatccggtttcggccggggatgagtggcgaacgggtgagtaacacgtgggtaatctgccctgtactctgggataagcctgggaaactgggtctaataccggatatgactactgagggcatcctcggtggtggaaagttccggcggtacaggatgaacccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcgccagggacgaagcgcaagtgacggtacctggataagaagcaccggctaactacgtgccagcagccgcggtaatacgtagggtgcgagcgttgtccggaattattgggcgtaaagagctcgtaggcggtttgtcgcgtcggccgtgaaatctccacgcttaacgtggagcgtgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacattccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcgccagacatccccagagatggggcttcccttgtggttggtgtacaggtggtgcatggctgtcgtcagctcgtgtcgtgagatgttgggttaagtcccgcaacgagcgcaacccttatcctacgttgccagcaagtaaagttggggactcgtgggagactgccggggtcaactcggaggaaggtggggatgacgtcaagtcatcatgccccttatgtccagggcttcacacatgctacaatggctggtacagagggctgcgataccgcgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaacccgcaagggagggagtggtcgaaggtgggactggcgattgggacgaagtcgtaacaaggtagccgtaccggaaggtgcggctggatcacctcctttctaa

SEQ ID NO: 1358 - DNA, 1531 bp, Amycolatopsis eurytherma
  ref <308>: DATABASE ACCESSION NUMBER: NCBI ACCESSION: NZ_RKHY01000001.1
  ref <309>: DATABASE ENTRY DATE: 2019-04-01
  ref <313>: RELEVANT RESIDUES IN SEQ ID NO: (1)..(1531)
ttgttggagagtttgatcctggctcaggacgaacgctggcggcgtgcttaacacatgcaagtcgaacgctgaagcaccttcgggtgtggatgagtggcgaacgggtgagtaacacgtgggtaacctgccctgtactttgggataagccctggaaacggggtctaataccgaatatgactcgctaaggcatcttggtgggtggaaagtttcggcggtacaggatgggcccgcggcctatcagcttgttggtggggtagtggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcgccagggacgaagcgcaagtgacggtacctggagaagaagcaccggctaactacgtgccagcagccgcggtaatacgtagggtgcaagcgttgtccggaattattgggcgtaaagagctcgtaggcggcttgtcgcgtctgctgtgaaaatccggggcttaactccggacctgcagtggatacgggcaggcttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacttccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcactggaaaccggcagagatgtcggcccccttgtggccggtgtgcaggtggtgcatggctgtcgtcagctcgtgtcgtgagatgttgggttaagtcccgcaacgagcgcaacccttgtcctgtgttgccagcgcgtaatggcggggactcgcgggagactgccggggtcaactcggaggaaggtggggatgacgtcaagtcatcatgccccttatgtccagggcttcacacatgctacaatggctggtacagagggctgcgataccgtgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaaccccgcttgcggggagggagtggtcgaaggtgggactggcgattgggacgaagtcgtaacaaggtagccgtaccggaaggtgcggctggatcacctcctttctaaggag

SEQ ID NO: 1359 - DNA, 1525 bp, Amycolatopsis palatopharyngis
  ref <308>: DATABASE ACCESSION NUMBER: NCBI ACCESSION: NZ_PQHZ01000108.1
  ref <309>: DATABASE ENTRY DATE: 2019-04-01
  ref <313>: RELEVANT RESIDUES IN SEQ ID NO: (1)..(1525)
ttgttggagagtttgatcctggctcaggacgaacgctggcggcgtgcttaacacatgcaagtcgaacgatgaagcctttcggggtggattagtggcgaacgggtgagtaacacgtgggtaatctgccctgtactttgggataagccttggaaacgaggtctaataccggatatgaccccacatcgcatggtgtggggtggaaagctccggcggtacgggatgagcccgcggcctatcagcttgttggtggggtagtggcctaccaaggcgtcgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcgccagggacgaagcctttcggggtgacggtacctggataagaagcaccggctaactacgtgccagcagccgcggtaatacgtagggtgcgagcgttgtccggaattattgggcgtaaagagctcgtaggcggtttgtcacgtcggccgtgaaaactggaggcttaacctccagcttgcggtcgatacgggcagacttgagttcggtaggggagactggaattcctggtgtagcggtggaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacttccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcactggaaaccggcagagatgtcggcccccttgtggccggtgtacaggtggtgcatggctgtcgtcagctcgtgtcgtgagatgttgggttaagtcccgcaacgagcgcaacccttatcctgtgttgccagcgcgtaatggcggggactcgcgggagactgccggggtcaactcggaggaaggtggggatgacgtcaagtcatcatgccccttatgtccagggcttcacacatgctacaatggctggtacagagggctgcgataccgtgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcacgaaagtcggtaacacccgaagcccacggcccaacctttcggggagggagtggtcgaaggtgggactggcgattgggacgaagtcgtaacaaggtagccgtaccggaaggtgcggctggatcacctcctttctaa

SEQ ID NO: 1360 - DNA, 1527 bp, Amycolatopsis ruanii
  ref <308>: DATABASE ACCESSION NUMBER: NCBI ACCESSION: NZ_PQHY01000144.1
  ref <309>: DATABASE ENTRY DATE: 2019-04-01
  ref <313>: RELEVANT RESIDUES IN SEQ ID NO: (1)..(1527)
ttgttggagagtttgatcctggctcaggacgaacgctggcggcgtgcttaacacatgcaagtcgaacgctgaagcatcttcgggtgtggatgagtggcgaacgggtgagtaacacgtgggtaacctgccctgtactttgggataagccctggaaacggggtctaataccgaatatgactccacaccgcatggtgtggggtggaaagtttcggcggtacgggatgggcccgcggcctatcagcttgttggtggggtgatggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcgccagggacgaagcgtaagtgacggtacctggagaagaagcaccggctaactacgtgccagcagccgcggtaatacgtagggtgcaagcgttgtccggaattattgggcgtaaagagctcgtaggcggcttgtcgcgtctgctgtgaaaatccggggcttaactccggacctgcagtggatacgggcaggcttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggtgacttccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcactggaaaccggcagagatgtcggcccccttgtggccggtgtgcaggtggtgcatggctgtcgtcagctcgtgtcgtgagatgttgggttaagtcccgcaacgagcgcaacccttgtcctgtgttgccagcgcgtaatggcggggactcgcgggagactgccggggtcaactcggaggaaggtggggatgacgtcaagtcatcatgccccttatgtccagggcttcacacatgctacaatggctggtacagagggctgcgataccgtgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaacccgtaagggagggagtggtcgaaggtgggactggcgattgggacgaagtcgtaacaaggtagccgtaccggaaggtgcggctggatcacctcctttctaaggag

SEQ ID NO: 1361 - DNA, 1436 bp, Amycolatopsis sp. GLM-1
  ref <308>: DATABASE ACCESSION NUMBER: NCBI ACCESSION: NZ_RSEC01000074.1
  ref <309>: DATABASE ENTRY DATE: 2019-04-01
  ref <313>: RELEVANT RESIDUES IN SEQ ID NO: (1)..(1436)
ggatgagtggcgaacgggtgagtaacacgtgggtaatctgccctgcactctgggataagccttggaaacgaggtctaataccggatatcactttctctcgcatgggagagggttgaaagttctggcggtgcaggatgaacccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcgccagggacgaagcgcaagtgacggtacctggataagaagcaccggctaactacgtgccagcagccgcggtaatacgtagggtgcgagcgttgtccggatttattgggcgtaaagagctcgtaggcggtttgtcgcgtcggccgtgaaatctccacgcttaacgtggagcgtgcggtcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacatccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcgccagacatccccagagatggggcttcccttgtggttggtgtacaggtggtgcatggctgtcgtcagctcgtgtcgtgagatgttgggttaagtcccgcaacgagcgcaacccttatcctacgttgccagcgcgttatggcggggactcgtgggagactgccggggtcaactcggaggaaggtggggatgacgtcaagtcatcatgccccttatgtccagggcttcacacatgctacaatggctggtacagagggctgcgataccgcgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaacccttcggggagggagtggtcgaaggtgggactggcgattgggacgaagtcgtaacaaggtagccgtaccggaaggtgcggctggatcacctcctttctaa

SEQ ID NO: 1362 - DNA, 1519 bp, Amycolatopsis sp. WAC 01375
  ref <308>: DATABASE ACCESSION NUMBER: NCBI ACCESSION: NZ_QHHW01000050.1
  ref <309>: DATABASE ENTRY DATE: 2019-04-01
  ref <313>: RELEVANT RESIDUES IN SEQ ID NO: (1)..(1519)
ttgttggagagtttgatcctggctcaggacgaacgctggcggcgtgcttaacacatgcaagtcgaacgatgaagccttcgggtggattagtggcgaacgggtgagtaacacgtgggcaatctgccctgtactttgggataagcctgggaaactgggtctaataccggatatcactgatcctcgcatgggggttggttgaaagttctggcggtacaggatgagcccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcgccagggacgaagcgcaagtgacggtacctggataagaagcaccggctaactacgtgccagcagccgcggtaatacgtagggtgcaagcgttgtccggaattattgggcgtaaagagctcgtaggcggtttgtcgcgtcgttcgtgaaaactccacgcttaacgtggagcgtgcgggcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacatccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcgccagacatccctagagatagggcttcccttgtggttggtgtacaggtggtgcatggctgtcgtcagctcgtgtcgtgagatgttgggttaagtcccgcaacgagcgcaacccttatcctacgttgccagcgcgttatggcggggactcgtgggagactgccggggtcaactcggaggaaggtggggatgacgtcaagtcatcatgccccttatgtccagggcttcacacatgctacaatggctggtacagagggctgcgataccgcgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaacccgcaagggggggagtggtcgaaggtgggactggcgattgggacgaagtcgtaacaaggtagccgtaccggaaggtgcggctggatcacctcctttctaa

SEQ ID NO: 1363 - DNA, 1519 bp, Amycolatopsis sp. WAC 01376
  ref <308>: DATABASE ACCESSION NUMBER: NCBI ACCESSION: NZ_QHKL01000017.1
  ref <309>: DATABASE ENTRY DATE: 2019-04-01
  ref <313>: RELEVANT RESIDUES IN SEQ ID NO: (1)..(1519)
ttgttggagagtttgatcctggctcaggacgaacgctggcggcgtgcttaacacatgcaagtcgaacgatgaagccttcgggtggattagtggcgaacgggtgagtaacacgtgggcaatctgccctgtactttgggataagcctgggaaactgggtctaataccggatatcactgactctcgcatgggggttggttgaaagttctggcggtacaggatgagcccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcgccagggacgaagcgcaagtgacggtacctggataagaagcaccggctaactacgtgccagcagccgcggtaatacgtagggtgcaagcgttgtccggaattattgggcgtaaagagctcgtaggcggtttgtcgcgtcgttcgtgaaaactccacgcttaacgtggagcgtgcgggcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacatccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcgccagacatccctagagatagggcttcccttgtggttggtgtacaggtggtgcatggctgtcgtcagctcgtgtcgtgagatgttgggttaagtcccgcaacgagcgcaacccttatcctacgttgccagcgcgttatggcggggactcgtgggagactgccggggtcaactcggaggaaggtggggatgacgtcaagtcatcatgccccttatgtccagggcttcacacatgctacaatggctggtacagagggctgcgataccgcgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccacggcccaacccgcaagggagggagtggtcgaaggtgggactggcgattgggacgaagtcgtaacaaggtagccgtaccggaaggtgcggctggatcacctcctttctaa

SEQ ID NO: 1364 - DNA, 1519 bp, Amycolatopsis sp. WAC 01416; identical to SEQ ID NO: 1362
  ref <308>: DATABASE ACCESSION NUMBER: NCBI ACCESSION: NZ_QHHX01000022.1
  ref <309>: DATABASE ENTRY DATE: 2019-04-01
  ref <313>: RELEVANT RESIDUES IN SEQ ID NO: (1)..(1519)

SEQ ID NO: 1365 - DNA, 1523 bp, Amycolatopsis sp. WAC 04169
  ref <308>: DATABASE ACCESSION NUMBER: NCBI ACCESSION: NZ_QHJI01000026.1
  ref <309>: DATABASE ENTRY DATE: 2019-04-01
  ref <313>: RELEVANT RESIDUES IN SEQ ID NO: (1)..(1523)
ttgttggagagtttgatcctggctcaggacgaacgctggcggcgtgcttaacacatgcaagtcgaacgatgatccggtttcggccggggattagtggcgaacgggtgagtaacacgtgggcaatctgccctgtactttgggataagcctgggaaactgggtctaataccggatatgacaggttctcgcatgggaacttgtggaaagctccggcggtacgggatgagcccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcgccagggacgaagcgcaagtgacggtacctggataagaagcaccggctaactacgtgccagcagccgcggtaatacgtagggtgcgagcgttgtccggaattattgggcgtaaagagctcgtaggcggtttgtcgcgtcgttcgtgaaaactccacgcttaacgtggagcgtgcgggcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacatccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcgccagacatccctagagatagggcttcccttgtggttggtgtacaggtggtgcatggctgtcgtcagctcgtgtcgtgagatgttgggttaagtcccgcaacgagcgcaacccttatcctacgttgccagcgcgttatggcggggactcgtgggagactgccggggtcaactcggaggaaggtggggatgacgtcaagtcatcatgccccttatgtccagggcttcacacatgctacaatggctggtacagagggctgcgataccgcgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaacccgcaagggggggagtggtcgaaggtgggactggcgattgggacgaagtcgtaacaaggtagccgtaccggaaggtgcggctggatcacctcctttctaa

SEQ ID NO: 1366 - DNA, 1521 bp, Amycolatopsis sp. WAC 04182
  ref <308>: DATABASE ACCESSION NUMBER: NCBI ACCESSION: NZ_QHJJ01000014.1
  ref <309>: DATABASE ENTRY DATE: 2019-04-01
  ref <313>: RELEVANT RESIDUES IN SEQ ID NO: (1)..(1521)
ttgttggagagtttgatcctggctcaggacgaacgctggcggcgtgcttaacacatgcaagtcgaacgatgaagcctttcggggtggattagtggcgaacgggtgagtaacacgtgggcaatctgccctgtactttgggataagcctgggaaactgggtctaataccggatatgactgctgatcgcatggttggtggtggaaagctccggcggtacaggatgagcccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcgccagggacgaagcgcaagtgacggtacctggataagaagcaccggctaactacgtgccagcagccgcggtaatacgtagggtgcgagcgttgtccggaattattgggcgtaaagagctcgtaggcggtttgtcgcgtcgttcgtgaaaactccacgcttaacgtggagcgtgcgggcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacatccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcgccagacatccctagagatagggcttcccttgtggttggtgtacaggtggtgcatggctgtcgtcagctcgtgtcgtgagatgttgggttaagtcccgcaacgagcgcaacccttatcctacgttgccagcgcgttatggcggggactcgtgggagactgccggggtcaactcggaggaaggtggggatgacgtcaagtcatcatgccccttatgtccagggcttcacacatgctacaatggctggtacagagggctgcgataccgcgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaacccgtaagggggggagtggtcgaaggtgggactggcgattgggacgaagtcgtaacaaggtagccgtaccggaaggtgcggctggatcacctcctttctaa

SEQ ID NO: 1367 - DNA, 1523 bp, Amycolatopsis sp. WAC 04197
  ref <308>: DATABASE ACCESSION NUMBER: NCBI ACCESSION: NZ_QHJK01000023.1
  ref <309>: DATABASE ENTRY DATE: 2019-04-01
  ref <313>: RELEVANT RESIDUES IN SEQ ID NO: (1)..(1523)
ttgttggagagtttgatcctggctcaggacgaacgctggcggcgtgcttaacacatgcaagtcgaacgatgaagccgtttcggtggtggattagtggcgaacgggtgagtaacacgtgggcaatctgccctgtactttgggataagcctgggaaactgggtctaataccggatatgacagagcctcgcatggggtttggtggaaagctccggcggtacgggatgagcccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcgccagggacgaagcgcaagtgacggtacctggataagaagcaccggctaactacgtgccagcagccgcggtaatacgtagggtgcgagcgttgtccggaattattgggcgtaaagagctcgtaggcggtttgtcgcgtcgttcgtgaaaactccacgcttaacgtggagcgtgcgggcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacatccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcgccagacatccctagagatagggcttcccttgtggttggtgtacaggtggtgcatggctgtcgtcagctcgtgtcgtgagatgttgggttaagtcccgcaacgagcgcaacccttatcctacgttgccagcgcgtcatggcggggactcgtgggagactgccggggtcaactcggaggaaggtggggatgacgtcaagtcatcatgccccttatgtccagggcttcacacatgctacaatggctggtacagagggctgcgataccgcgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaacccgcaagggggggagtggtcgaaggtgggactggcgattgggacgaagtcgtaacaaggtagccgtaccggaaggtgcggctggatcacctcctttctaa

SEQ ID NO: 1368 - DNA, 1526 bp, Amycolatopsis sp. YIM PH 21725
  ref <308>: DATABASE ACCESSION NUMBER: NCBI ACCESSION: NZ_QZFV01000022.1
  ref <309>: DATABASE ENTRY DATE: 2019-04-01
  ref <313>: RELEVANT RESIDUES IN SEQ ID NO: (1)..(1526)
ttgttggagagtttgatcctggctcaggacgaacgctggcggcgtgcttaacacatgcaagtcgaacgctgaagcatcttcgggtgtggatgagtggcgaacgggtgagtaacacgtgggtaatctgccctgtactttgggataagcctgggaaactgggtctaataccggatatgactgccttgggcatccagggtggtggaaagtttcggcggtacgggatgagcccgcggcctatcagcttgttggtggggtgatggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcgcgcacgacgaagcgagagtgacggtagtgcgataagaagcaccggctaactacgtgccagcagccgcggtaatacgtagggtgcgagcgttgtccggaattattgggcgtaaagagctcgtaggcggtttgtcgcgtcggccgtgaaatctggaggcttaaccttcagcgtgcggtcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacattccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcgccagacatctccagagatggggcttcccttgtggttggtgtacaggtggtgcatggctgtcgtcagctcgtgtcgtgagatgttgggttaagtcccgcaacgagcgcaacccttatcctatgttgccagcgcgtcatggcggggactcgtgggagactgccggggtcaactcggaggaaggtggggatgacgtcaagtcatcatgccccttatgtccagggcttcacacatgctacaatggctggtacagagggttgcgatatcgtgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaaccccgtcaggggagggagtggtcgaaggtgggactggcgattgggacgaagtcgtaacaaggtagccgtaccggaaggtgcggctggatcacctcctttctaa

SEQ ID NO: 1369 - DNA, 1527 bp, Amycolatopsis thermalba
  ref <308>: DATABASE ACCESSION NUMBER: NCBI ACCESSION: NZ_PQHX01000162.1
  ref <309>: DATABASE ENTRY DATE: 2019-04-01
  ref <313>: RELEVANT RESIDUES IN SEQ ID NO: (1)..(1527)
ttgttggagagtttgatcctggctcaggacgaacgctggcggcgtgcttaacacatgcaagtcgaacgctgaagcatcttcgggtgtggatgagtggcgaacgggtgagtaacacgtgggtaacctgccctgtactttgggataagccctggaaacggggtctaataccggatacgacctgctgaggcatcttggtgggtggaaagtttcggcggtacgggatgggcccgcggcctatcagcttgttggtggggtgatggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcgccagggacgaagcgtaagtgacggtacctggagaagaagcaccggctaactacgtgccagcagccgcggtaatacgtagggtgcaagcgttgtccggaattattgggcgtaaagagctcgtaggcggcttgtcgcgtctgctgtgaaaatccggggcttaactccggacctgcagtggatacgggcaggcttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggtgacttccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcactggaaaccggcagagatgtcggcccccttgtggccggtgtgcaggtggtgcatggctgtcgtcagctcgtgtcgtgagatgttgggttaagtcccgcaacgagcgcaacccttgtcctgtgttgccagcgcgtaatggcggggactcgcgggagactgccggggtcaactcggaggaaggtggggatgacgtcaagtcatcatgccccttatgtccagggcttcacacatgctacaatggctggtacagagggctgcgataccgtgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaacccgtaagggagggagtggtcgaaggtgggactggcgattgggacgaagtcgtaacaaggtagccgtaccggaaggtgcggctggatcacctcctttctaaggag

SEQ ID NO: 1370 - DNA, 1423 bp, Anabaena sp. 4-3
  ref <308>: DATABASE ACCESSION NUMBER: NCBI ACCESSION: NZ_LUHJ01000040.1
  ref <309>: DATABASE ENTRY DATE: 2019-04-01
  ref <313>: RELEVANT RESIDUES IN SEQ ID NO: (1)..(1423)
ttcggagatagtggcggacgggtgagtaacgcgtgagaatctggctctaggtcggggacaaccactggaaacggtggctaataccggatgtgccggaaggtgaaagattaattgcctagagatgagctcgcgtctgattagctagttggtggtgtaagggactaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcaaggaataacacaatgaaggtacttgaggaataagcatcggctaactccgtgccagcagccgcggtaatacggaggatgcaagcgttatccggaatgattgggcgtaaagagtccgtaggtggttctgtaagtctgctgtcaaagcacaaggctcaaccttgtaaaggcagtggaaactacagagctagagtgcgttcggggtagaaggaattcctggtgtagcggtgaaatgcgtagatatcaggaagaacaccggtggcgaaagcgttctgctaggccgcaactgacactgagggacgaaagctaggggagcgaatgggattagataccccagtagtcctagccgtaaacgatggatactaggcgtggcttgtatcgacccgagccgtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatcccggtgaaagctgggagtgccttcgggagcgcgaacacaggtggtgcatggctgtcgtcagctcgtgtcgtgagatgttgggttaagtcccgcaacgagcgcaaccctcgtttttagttgccagcattgagttgggcactctagagagactgccggtgacaaaccggaggaaggtggggatgacgtcaagtcagcatgccccttacgtcctgggctacacacgtactacaatgctacggacaaagggcagcaagcaggcgactgcaagcaaatctcagaaaccgtagctcagttcagatcgaaggctgcaactcgccttcgtgaagtcggaatcgctagtaattgcaggtcagcatactgcagtgaattcgttcccgggccttgtacacaccgcccgtcacaccatggaagtcggtcacgcccgaagtcattactccaacccttcggggaggaggatgcctaaggcaggactggtgactggggtgaagtcgtaacaaggtagccgtaccggaaggtgtggctggatcacctcctttttaggga

SEQ ID NO: 1371 - DNA, 1490 bp, Anabaena sp. 90
  ref <308>: DATABASE ACCESSION NUMBER: NCBI ACCESSION: NC_019427.1
  ref <309>: DATABASE ENTRY DATE: 2019-04-01
  ref <313>: RELEVANT RESIDUES IN SEQ ID NO: (1)..(1490)
aaaatggagagtttgatcctggctcaggatgaacgctggcggtatgcttaacacatgcaagtcgaacggaatctttagggatttagtggcggacgggtgagtaacgcgtaagaatctaccttcaggttggggacaaccactggaaacggtggctaataccgaatgtgccgagaggtgaaaggcttgctgcctgaagaagagcttgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaaaaaaatgacggtacctgaggaataagcatcggctaactccgtgccagcagccgcggtaatacggaggatgcaagcgttatccggaatgattgggcgtaaagggtccgcaggtggcattgtatgtctgctgttaaagagtttggctcaaccaaatcaaagcagtggaaactacaaagctagagtatggtcggggcagagggaattcctggtgtagcggtgaaatgcgtagatatcaggaagaacaccggtggcgaaggcgctctgctaggccaaaactgacactgagggacgaaagctaggggagcgaatgggattagataccccagtagtcctagccgtaaacgatggatactaggtgtagctcgtatcgacccgagctgtaccgtagctaacgcgttaagtatcccgcctggggagtacgcaggcaactgtgaaactcaaaggaattgacgggggcccgcacaagcggtggagtatgtggtttaattcgatgcaacgcgaagaaccttaccaaggcttgacatgtcacgaatcccggcgaaaattgggagtgccttagggagcgtgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctccggacaaagggcagctacacagcgatgtgatgcgaatctcataaaccggagctcagttcagatcgaaggctgcaactcgccttcgtgaaggaggaatcgctagtaattgcaggtcagcatactgcagtgaattcgttcccgggccttgtacacaccgcccgtcacaccatggaagttggtcacgcccgaagtcgttaccccaaccttttggagggggatgcctaaggtaggactgatgactggggtgaagtcgtaacaaggtagccgtaccggaaggtgtggctggatcacctcctttt

SEQ ID NO: 1372 - DNA, 1496 bp, Anabaena sp. CA ATCC 33047
  ref <308>: DATABASE ACCESSION NUMBER: NCBI ACCESSION: NZ_LUHI01000028.1
  ref <309>: DATABASE ENTRY DATE: 2019-04-01
  ref <313>: RELEVANT RESIDUES IN SEQ ID NO: (1)..(1496)
aaaacggagagtttgatcctggctcaggatgaacgctggcggtatgcttaacacatgcaagtcgaacggtctcttcggagatagtggcggacgggtgagtaacgcgtgagaatctggctctaggtcggggacaaccactggaaacggtggctaataccggatgtgccggaaggtgaaagattaattgcctagagatgagctcgcgtctgattagctagttggtggtgtaagggactaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggcttttgggttgtaaacctcttttctcaaggaataacacaatgaaggtacttgaggaataagcatcggctaactccgtgccagcagccgcggtaatacggaggatgcaagcgttatccggaatgattgggcgtaaagagtccgtaggtggttctgtaagtctgctgtcaaagcacaaggctcaaccttgtaaaggcagtggaaactacagagctagagtgcgttcggggtagaaggaattcctggtgtagcggtgaaatgcgtagatatcaggaagaacaccggtggcgaaagcgttctgctaggccgcaactgacactgagggacgaaagctaggggagcgaatgggattagataccccagtagtcctagccgtaaacgatggatactaggcgtggcttgtatcgacccgagccgtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatcccggtgaaagctgggagtgccttcgggagcgcgaacacaggtggtgcatggctgtcgtcagctcgtgtcgtgagatgttgggttaagtcccgcaacgagcgcaaccctcgtttttagttgccagcattgagttgggcactctagagagactgccggtgacaaaccggaggaaggtggggatgacgtcaagtcagcatgccccttacgtcctgggctacacacgtactacaatgctacggacaaagggcagcaagcaggcgactgcaagcaaatctcagaaaccgtagctcagttcagatcgaaggctgcaactcgccttcgtgaagtcggaatcgctagtaattgcaggtcagcatactgcagtgaattcgttcccgggccttgtacacaccgcccgtcacaccatggaagtcggtcacgcccgaagtcattactccaacccttcggggaggaggatgcctaaggcaggactggtgactggggtgaagtcgtaacaaggtagccgtaccggaaggtgtggctggatcacctcctttttaggga

SEQ ID NO: 1373 - DNA, 1496 bp, Anabaena sp. PCC 7108
  ref <308>: DATABASE ACCESSION NUMBER: NCBI ACCESSION: NZ_KB235896.1
  ref <309>: DATABASE ENTRY DATE: 2019-04-01
  ref <313>: RELEVANT RESIDUES IN SEQ ID NO: (1)..(1496)
aaaacggagagtttgatcctggctcaggatgaacgctggcggtatgcttaacacatgcaagtcgaacggaatccttagggatttagtggcggacgggtgagtaacgcgtgagaatctggcttcaggtctgggacaaccactggaaacggtggctaataccggatgtgccgagaggtaaaaggcttgctgcctgaagatgagcttgcgtctgattagctagttggtagtgtaatggactaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaaaaaaatgacggtacctgaggaataagcatcggctaactccgtgccagcagccgcggtaatacggaggatgcaagcgttatccggaatgattgggcgtaaagggtccgcaggtggctatgtaagtctgctgttaaagagcgaggctcaaccttgtaagagcagtggaaactacatagctagagtgcgttcggggcagagggaattcctggtgtagcggtgaaatgcgtagatatcaggaagaacaccggtggcgaaagcgctctgctaggccgcaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgttgcgaatcttcttgaaaggggagagtgccttagggagcgcaaacacaggtggtgcatggctgtcgtcagctcgtgtcgtgagatgttgggttaagtcccgcaacgagcgcaaccctcgtttctagttgccagcaataagatgggaactctagagagactgccggtgacaaaccggaggaaggtggggatgacgtcaagtcagcatgccccttacgtcttgggctacacacgtactacaatgctacggacaaagggcagcaagcgcgcgagtgcaagcaaatcccataaaccgtagctcagttcagatcgaaggctgcaactcgccttcgtgaaggaggaatcgctagtaattgcaggtcagcatactgcagtgaattcgttcccgggccttgtacacaccgcccgtcacaccatggaagtcggtcacgcccgaagtcgttaccccaaccgaaaggagggggatgcctaaggtaggactggtgactggggtgaagtcgtaacaaggtagccgtaccggaaggtgtggctggatcacctcctttttaggga

SEQ ID NO: 1374 - DNA, 1488 bp, Anabaena sp. WA102
  ref <308>: DATABASE ACCESSION NUMBER: NCBI ACCESSION: NZ_CP011456.1
  ref <309>: DATABASE ENTRY DATE: 2019-04-01
  ref <313>: RELEVANT RESIDUES IN SEQ ID NO: (1)..(1488)
aaaatggagagtttgatcctggctcaggatgaacgctggcggtatgcttaacacatgcaagtcgaacggtcttttcggagatagtggcggacgggtgagtaacgcgtaagaatctaccttcaggttggggacaaccactggaaacggtggctaatacccaatgtgccgagaggtgaaaggcttgctgcctgaagaagagcttgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaacaaaatgacggtacctgaggaataagcatcggctaactccgtgccagcagccgcggtaatacggaggatgcaagcgttatccggaatgattgggcgtaaagggtccgcaggtggcattgtaagtctgctgttaaagagtttggctcaaccaaataaaagcagtggaaactacaaagctagagtgtggtcggggcagagggaattcctggtgtagcggtgaaatgcgtagatatcaggaagaacaccggtggcgaaggcgctctgctaggccaagactgacactgagggacgaaagctaggggagcgaatgggattagataccccagtagtcctagccgtaaacgatggatactaggcgtagctcgtatcgacccgagctgtgccgtagctaacgcgttaagtatcccgcctggggagtacgcaggcaactgtgaaactcaaaggaattgacgggggcccgcacaagcggtggagtatgtggtttaattcgatgcaacgcgaagaaccttaccaaggcttgacatgtcacgaattccgttgaaagatggaagtgccttcgggagcgtgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctacggacaaagggcagctacacagcgatgtgatgcgaatctcataaaccgtagctcagttcagatcgaaggctgcaactcgccttcgtgaaggaggaatcgctagtaattgcaggtcagcatactgcagtgaattcgttcccgggccttgtacacaccgcccgtcacaccatggaagttggtcacgcccgaagtcgttaccccaaccgcaaggagggggatgcctaaggtaggactgatgactggggtgaagtcgtaacaaggtagccgtaccggaaggtgtggctggatcacctcctttt

SEQ ID NO: 1375 - DNA, 519 bp, Anaeroarcus burkinensis
  ref <308>: DATABASE ACCESSION NUMBER: NCBI ACCESSION: NZ_AUMI01000020.1
  ref <309>: DATABASE ENTRY DATE: 2019-04-01
  ref <313>: RELEVANT RESIDUES IN SEQ ID NO: (1)..(519)
ttttatcggagagtttgatcctggctcaggacgaacgctggcggcgtgcttaacacatgcaagtcgaacggtccaaagcttaacaccgagaacatactgcttaaaggcagagcggtggcgaagtgaaacgagccatcacgcatacataaagtgattatcaagcaaaatgttttgggtgttgagctttggatagtggcgaacgggtgagtaacgcgtaggcaatctgccttctagatggggacaacatcccgaaaggggtgctaataccgaatgttgtaggagcttcgcatggacaagatactaaaggtggcctctgaatatgctaccgctagaagatgagcctgcgtctgattagctagttggaggggtaacggcccaccaaggcttcgatcagtagccggtctgagaggatgaacggccacactgggactgagacacggcccagactcctacgggaggcagcagtggggaatcttccgcaatggacgaaagtctgacggagcaacgccgcgtgagtga

SEQ ID NO: 1376 - DNA, 2572 bp, Anaerobacillus alkalidiazotrophicus
  misc_feature (270)..(270): n is a, c, g, or t
  misc_feature (937)..(937): n is a, c, g, or t
  misc_feature (2063)..(2063): n is a, c, g, or t
  ref <308>: DATABASE ACCESSION NUMBER: NCBI ACCESSION: NZ_MLQS01000001.1
  ref <309>: DATABASE ENTRY DATE: 2019-04-01
  ref <313>: RELEVANT RESIDUES IN SEQ ID NO: (1)..(2572)
tttatggagagtttgatcctggctcaggacgaacgctggcggcgtgcctaatacatgcaagtcgagcgaatggatgggagcttgctccctgaaattagcggcggacgggtgagtaacacgtgggcaacctgccctgtagactgggataacttcgggaaaccgaagctaataccggataatctttggagcctcatggttctaaagtgaaagttgggtttacctaacactacaggatgggcccgcgtcgcattagctagttggtaaggtaanggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtactattcgaatagggtagtaccttgacggtacctaacgagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtgcagaagaggagagtggtttacctaacactacaggatgggcccgcgtcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtaccgttcnaatagggcggtaccttgacggtacctaacgagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatccttatgacctccctagagatagggatttcccttcggggacataagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcgaaaccgcgaggttgagccaatcccataaagccattctcagttcggattgtaggctgcaactcgcctacatgaagccgcgagatagggatttcccttcggggacataagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcganaccgcgaggttgagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctatggagtcacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1377 - DNA, 1366 bp, Anaerobacillus alkalilacustris
  ref <308>: DATABASE ACCESSION NUMBER: NCBI ACCESSION: NZ_MLQR01000001.1
  ref <309>: DATABASE ENTRY DATE: 2019-04-01
  ref <313>: RELEVANT RESIDUES IN SEQ ID NO: (1)..(1366)
atagggaccgaacaagtgaaagttgggtttacctaacactacaggatgggcccgcgtcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtaccgttcaaatagggcggtaccttgacggtacctaacgagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatccttatgacctccctagagatagggatttcccttcggggacataagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcgagaccgcgaggttgagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1378 - DNA, 1340 bp, Anaerobacillus arseniciselenatis
  ref <308>: DATABASE ACCESSION NUMBER: NCBI ACCESSION: NZ_MLQQ01000001.1
  ref <309>: DATABASE ENTRY DATE: 2019-04-01
  ref <313>: RELEVANT RESIDUES IN SEQ ID NO: (1)..(1340)
tctaaagtaaaagttgggtttacctaacactacgggatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgctagggaagaacaagtaccgttcaaatagggcggtaccttgacggtacctagcgagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccactctagagatagagctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagagcagcaaaaccgcgaggtcgagccaatctcataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacctaaggtgggacagatgattggggtgaagtcgtaacaaggtagccgtatcggaaggtgcggctggatcacctcctttcta

SEQ ID NO: 1379 - DNA, 1933 bp, Anaerobacillus isosaccharinicus
  misc_feature (271)..(271): n is a, c, g, or t
  misc_feature (285)..(285): n is a, c, g, or t
  misc_feature (472)..(472): n is a, c, g, or t
  misc_feature (486)..(486): n is a, c, g, or t
  misc_feature (1209)..(1209): n is a, c, g, or t
  misc_feature (1841)..(1841): n is a, c, g, or t
  ref <308>: DATABASE ACCESSION NUMBER: NCBI ACCESSION: NZ_LQXD01000001.1
  ref <309>: DATABASE ENTRY DATE: 2019-04-01
  ref <313>: RELEVANT RESIDUES IN SEQ ID NO: (1)..(1933)
tttatggagagtttgatcctggctcaggacgaacgctggcggcgtgcctaatacatgcaagtcgagcggacaattgagagcttgctctcaattgttagcggcggacgggtgagtaacacgtgggcaacctgccctgtagactgggataacttcgggaaaccgaagctaataccggataatctttagcatcacatggtgcaaaagtaaaagttgggttttacctaacactacaggatgggcccgcggcgcattagctagttggtaaggtaanggcttaccaaggcnacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtaccgttcnaatagggcggtacnttgacggtacctaaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggagacttgagtgcagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgacaaccctagagatagggctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaangtggtttaattcgaagcaacgcgaagaaccttaccaggtcttgacatcctttgacaaccctagagatagggctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggttgagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttctatggagttaaaactctagtcgatgcttttcttaggnggagccagccgcctaaggtgggacagatgattggggtgaagtcgtaacaaggtagccgtatcggaaggtgcggctggatcacctcctttcta

SEQ ID NO: 1380 - DNA, 1556 bp, Anaerobacillus macyae
  ref <308>: DATABASE ACCESSION NUMBER: NCBI ACCESSION: NZ_LELK01000003.1
  ref <309>: DATABASE ENTRY DATE: 2019-04-01
  ref <313>: RELEVANT RESIDUES IN SEQ ID NO: (1)..(1556)
tctatcggagagtttgatcctggctcaggacgaacgctggcggcgtgcctaatacatgcaagtcgagcggagatttgggagcttgctcccaaatcttagcggcggacgggtgagtaacacgtgggcaacctgccctgcagactgggataactccgggaaaccggagctaataccgggtaatacatcgcaccgcatggtgcaatgttgaaagttggctttcgagctaacactgcaggatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggccttcgggtcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaggacttgagtgcagaagaggagagtggaattccacgtgtagcggtgaaatgcgtagatatgtggaggaacaccagtggcgaaggcggctctctggtctgtaactgacgctgaggcgcgaaagcgtggggagcaaacaggattagataccctggtagtccacgccgtaaacgatgagtgctaggtgttggggggttccaccctcagtgctgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagcaacaccgcgaggtgaagcgaatcccataaagccgttctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtggggtaacctttatggagccagccgccgaaggtgggacaaatgattggggtgaagtcgtaacaaggtagccgtatcggaaggtgcggctggatcacctcctttcta

SEQ ID NO: 1381 - DNA, 1527 bp, Anaerococcus nagyae
  ref <308>: DATABASE ACCESSION NUMBER: NCBI ACCESSION: NZ_QVEU01000005.1
  ref <309>: DATABASE ENTRY DATE: 2019-04-01
  ref <313>: RELEVANT RESIDUES IN SEQ ID NO: (1)..(1527)
atgagagtttgatcctggctcaggattaacgctggcggcgtgcataacacatgcaagtcgaacgatgaaactttaatgaacccttcggggagaattaaagcggattagtggcgaacgggtgagtaacgcgtgagtaacctgccttacacaaggggatagcctttggaaacgaagaataataccctataaaaccataaaagcacatgcaattatggtcaaagtgatagcggtgtaagatggacttgcgtctgattagctagttggtgagataaaagcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggtccggctaattacgtgccagcagccgcggtaatacgtaaggaccgagcgttgtccggaatcattgggcgtaaagggtacgtaggcggctagaaaagttagaagtcaaaggctatagctcaactatagtaagcttctaaaactatttagcttgagagatggaagggaaagtggaattcctagtgtagcggtggaatgcgcagatattaggaggaataccggtggcgaaggcgactttctggccattttctgacgctgaggtacgaaagcgtgggtagcaaacaggattagataccctggtagtccacgccgtaaacgatgagtgttaggtgtctggagtcaaatctgggtgccgcagcaaacgcattaaacactccgcctggggagtacgcacgcaagtgtgaaactcaaaggaattgacggggacccgcacaagcagcggagcatgtggtttaattcgacgcaacgcgaagaaccttaccaagtcttgacatattttagaagcaattagagataagtgcctatatcttcggataactaaaatacaggtggtgcatggttgtcgtcagctcgtgtcgtgagatgttgggttaagtcccataacgagcgcaacccctattgctagttaccatcattaagttggggactctagtaatactgccggtgacaaaccggaggaaggtggggatgacgtcaaatcatcatgccctttatgacttgggctacacacgtgctacaatggcaggtacacagggaagcaagactgtgaagttaagcaaaactcaaaaagcctgtcccagttcggattgcactctgcaactcgagtgcatgaagttggagttgctagtaatcgcagatcagaatgctgcggtgaatgcgttcccgggtcttgtacacaccgcccgtcacaccatggaagttggcaatacccgaagcctgtgagcgaaccctttggggcgcagcagtcgaaggtagggtcagtaactggggtgaagtcgtaacaaggtagccgtatcggaaggtgcggctggatcacctcctttct

SEQ ID NO: 1382 - DNA, 1526 bp, Anaerococcus octavius
  ref <308>: DATABASE ACCESSION NUMBER: NCBI ACCESSION: NZ_UFTA01000002.1
  ref <309>: DATABASE ENTRY DATE: 2019-04-01
  ref <313>: RELEVANT RESIDUES IN SEQ ID NO: (1)..(1526)
atgagagtttgatcctggctcaggattaacgctggcggcgtgcataacacatgcaagtcgaacgatgaaacttaaatgatttcttcggaatgaacttaagtggattagtggcggacgggtgagtaacgcgtgagtaacctgccttacacaaggggatagccgttggaaacgacgaataataccctatgaaactatcacttcgcatgaagcgatagtcaaagtgttagcggtgtaagatggacttgcgtctgattagctagttggtgagaaaaaagcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggtccggctaattacgtgccagcagccgcggtaatacgtaaggaccgagcgttgtccggaatcattgggcgtaaagggtacgtaggcgggtcattaagttagaagtcaaaggctatagctcaactatagtaagcttctaaaactggagaccttgagtaatggaagggaaagtggaattcctagtgtagcggtggaatgcgcagatattaggaggaataccggtggcgaaggcgactttctggccattaactgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcacgcaagtgtgaaactcaaaggaattgacggggacccgcacaagcagcggagcatgtggtttaattcgaagcaacgcgaagaaccttaccaagtcttgacatattttggaaacacttagagataagtgcctatatcttcggataactgaaatacaggtggtgcatggttgtcgtcagctcgtgtcgtgagatgttgggttaagtcccataacgagcgcaacccctatggctagttaccatcattaagttggggactctagcaatactgccggtgacaaaccggaggaaggtggggatgacgtcaaatcatcatgccctttatgacttgggctacacacgtgctacaatggcaggtacagagggcagcaagacagcgatgttaagcaaaactcaaaaagcctgtcccagttcggattgcactctgcaactcgagtgcatgaagttggagttgctagtaatcgtggatcagaatgccacggtgaatgcgttcccgggtcttgtacacaccgcccgtcacaccatggaagttggcaatacccgaagcctgtgagcgaaccattaaggacgcagcagtcgaaggtagggtcagtaactggggtgaagtcgtaacaaggtagccgtatcggaaggtgcggctggatcacctcctttct

SEQ ID NO: 1383 - DNA, 1530 bp, Anaerococcus prevotii
  ref <308>: DATABASE ACCESSION NUMBER: NCBI ACCESSION: NZ_UFSY01000001.1
  ref <309>: DATABASE ENTRY DATE: 2019-04-01
  ref <313>: RELEVANT RESIDUES IN SEQ ID NO: (1)..(1530)
tttatgagagtttgatcctggctcaggataaacgctggcggcgtgcataacacatgcaagtcgaacgatgaagcttaaatgatctcttcggagtgactttaagtggattagtggcggacgggtgagtaacgcgtgagtaacctgccttgcacaaggggatagccgttggaaacgacgaataataccctatgatatgatagtctcgcatgagattatcatcaaagatttatcggtgtaagatggactcgcgtctgattagctagttggtggggtaactgctcaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtatgggaagaaaatgacagtaccatacgaataaggaccggctaattacgtgccagcagccgcggtaatacgtaaggtccgagcgttgtccggaatcattgggcgtaaagggtacgtaggcggataagcaagttagaagtgaaatcctatagctcaactatagtaagcttttaaaactgctcatcttgaggtatggaagggaaagtggaattcctagtgtagcggtgaaatgcgcagatattaggaggaataccggtggcgaaggcgactttctggccataaactgacgctgaggtacgaaagcgtgggtagcaaacaggattagataccctggtagtccacgccgtaaacgatgagtgttaggtgtctggaataatctgggtgccgcagctaacgcaataaacactccgcctggggagtacgcacgcaagtgtgaaactcaaaggaattgacggggacccgcacaagcagcggagcatgtggtttaattcgacgcaacgcgaagaaccttaccaagtcttgacatattacggcggggtctagagatagactcttacttcttcggaagactgtaatacaggtggtgcatggttgtcgtcagctcgtgtcgtgagatgttgggttaagtcccataacgagcgcaacccctattgttagttaccatcattaagttggggactctagcaatactgccggtgacaaaccggaggaaggtggggatgacgtcaaatcatcatgccctttatgacttgggctacacacgtgctacaatggcaggtacagagggaagcgagactgcgaagttaagcaaaactcaaaaagcctgtcccagttcggattgcactctgcaactcgagtgcatgaagttggagttgctagtaatcgcagatcagaatgctgcggtgaatgcgttcccgggtcttgtacacaccgcccgtcacaccatggaagttggcaatacccgaagcctgtgagcgaaccttttagggcgcagcagtcgaaggtagggtcagtaactggggtgaagtcgtaacaaggtagccgtatcggaaggtgcggctggatcacctcctttctaa

SEQ ID NO: 1384 - DNA, 1531 bp, Anaerococcus sp. Marseille-P3557
  ref <308>: DATABASE ACCESSION NUMBER: NCBI ACCESSION: NZ_OLMF01000004.1
  ref <309>: DATABASE ENTRY DATE: 2019-04-01
  ref <313>: RELEVANT RESIDUES IN SEQ ID NO: (1)..(1531)
tttatgagagtttgatcctggctcaggataaacgctggcggcgtgcataacacatgcaagtcgaacgatgaagcttaaatgatctcttcggagtgactttaagtggattagtggcggacgggtgagtaacgcgtgagtaacctgccttgcacaaggggatagccgttggaaacgacgaataataccctatgatatcaacctatcgcatgataagttgatcaaagatttatcggtgtaagatggactcgcgtctgattagctagttggtggggtaaaagcctaccaaggcaacgatcagtagccggcttgagagagtgtacggccacattgggactgagacacggcccagactcctacgggaggcagcagtggggaattttgcacaatgggggcaaccctgatgcagcgacgccgcgtgatttagaaggccttcgggttgtaaaaatcttttgtatgggaagaaaatgacagtaccatacgaataaggaccggctaattacgtgccagcagccgcggtaatacgtaaggtccgagcgttgtccggaatcattgggcgtaaagggtacgtaggcggataagcaagttagaagtgaaatcctatagctcaactatagtaagcttttaaaactgttcatcttgaggtatggaagggaaagtggaattcctagtgtagcggtgaaatgcgcagatattaggaggaataccggtggcgaaggcgactttctggccataaactgacgctgaggtacgaaagcgtgggtagcaaacaggattagataccctggtagtccacgccgtaaacgatgagtgttaggtgtctggaataatctgggtgccgcagctaacgcaataaacactccgcctggggagtacgcacgcaagtgtgaaactcaaaggaattgacggggacccgcacaagcagcggagcatgtggtttaattcgacgcaacgcgaagaaccttaccaagtcttgacatattacggaggtatgtagagatacgtacttacttcttcggaagactgtaatacaggtggtgcatggttgtcgtcagctcgtgtcgtgagatgttgggttaagtcccataacgagcgcaacccctattgttagttaccatcattaagttggggactctagcaatactgccggtgacaaaccggaggaaggtggggatgacgtcaaatcatcatgccctttatgacttgggctacacacgtgctacaatggcaggtacagagggaagcgaaactgtgaagtcaagcgaaactcaaaaagcctgtcccagttcggattgcactctgcaactcgagtgcatgaagttggagttgctagtaatcgcagatcagaatgctgcggtgaatgcgttcccgggtcttgtacacaccgcccgtcacaccatggaagttggcaatacccgaagcctgtgagctaacctttgggagcagcagtcgaaggtagggtcagtaactggggtgaagtcgtaacaaggtagccgtatcggaaggtgcggctggatcacctcctttctaagga

SEQ ID NO: 1385 - DNA, 1532 bp, Anaerococcus sp. Marseille-P3915
  ref <308>: DATABASE ACCESSION NUMBER: NCBI ACCESSION: NZ_LT984888.1
  ref <309>: DATABASE ENTRY DATE: 2019-04-01
  ref <313>: RELEVANT RESIDUES IN SEQ ID NO: (1)..(1532)
tttttatgagagtttgatcctggctcaggattaacgctggcggcgtgcataacacatgcaagtcgaacgatgaaacttaattgatctcttcggagtgattttaagtggattagtggcggacgggtgagtaacgcgtgagtaacctgccttagagatggggatagcctctggaaacggagaataatacccaatgataccaagttatcgcatggtagcctggtcaaagatttatcgctctaagatggacttgcgtctgattagctagttggtgagataatagctcaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggaccggctaattacgtgccagcagccgcggtaatacgtaaggtccgagcgttgtccggaatcattgggcgtaaagggtacgtaggcgggtaagcaagttagaagtgaaatcctatagctcaactatagtaagcttttaaaactgctcatcttgaggtatggaagggaaagtggaattcctagtgtagcggtgaaatgcgcagatattaggaggaataccggtggcgaaggcgactttctggccataacctgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcacgcaagtgtgaaactcaaaggaattgacggggacccgcacaagcagcggagcatgtggtttaattcgacgcaacgcgaagaaccttaccaagtcttgacatattacggcgggagctagagatagttccttacttcttcggaagactgtaatacaggtggtgcatggttgtcgtcagctcgtgtcgtgagatgttgggttaagtcccataacgagcgcaacccctattgttagttaccatcattaagttggggactctaacgatactgccggtgacaaaccggaggaaggtggggatgacgtcaaatcatcatgccctttatgacttgggctacacacgtgctacaatggcaggtacacagagcagcaagacagcgatgtcaagcaaatctcaaaaagcctgtcccagttcggattgcactctgcaactcgagtgcatgaagttggagttgctagtaatcgtggatcagaatgccgcggtgaatgcgttcccgggtcttgtacacaccgcccgtcacaccatggaagttggcaatacccgaagcctgtgagcgaaccttttggacgcagcagtcgaaggtagggtcagtaactggggtgaagtcgtaacaaggtagccgtatcggaaggtgcggctggatcacctcctttctaa

SEQ ID NO: 1386 - DNA, 904 bp, Anaerocolumna jejuensis
  ref <308>: DATABASE ACCESSION NUMBER: NCBI ACCESSION: NZ_FRAC01000004.1
  ref <309>: DATABASE ENTRY DATE: 2019-04-01
  ref <313>: RELEVANT RESIDUES IN SEQ ID NO: (1)..(904)
ggtataagatggacccgcgtctgattagctagttggtaaggtaacggcctaccaaggcaacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaacgggaggcaactcctttgacggtacctgactaagaagccccggctaactacgtgccagcagccgcggtaatacgtagggggcaagcgttatccggatttactgggtgtaaagggagcgtagacggtgatgtaagtcagatgtgaaagcccggggctcaaccccgggactgcatttgaaactatgttgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaaagctcttcggtgccgtcgcaaacgcattaagtattccacctggggagtacgttcgcaagaatgaaactcaaaggaattgacggggacccgcacaagcggtggagcatgtggtttaattcgaagcaacgcgaagaaccttaccaggtcttgacatccccctgaccggtccgtaacgggacctttccttcgggacaggggagacaggtggtgcatggttgtcgtcagctcgtgtcgtgagatgttgggttaagtcccgcaacgagcgcaacccttatccttagtagccagca

SEQ ID NO: 1387 - DNA, 1295 bp, Anaerocolumna xylanovorans
  ref <308>: DATABASE ACCESSION NUMBER: NCBI ACCESSION: NZ_FRFD01000002.1
  ref <309>: DATABASE ENTRY DATE: 2019-04-01
  ref <313>: RELEVANT RESIDUES IN SEQ ID NO: (1)..(1295)
agagtggaagttttcggatggaagcttttaacttagtggcggacgggtgagtaacgcgtgggtaacctgccttacacagggggataacagttggaaacgactgctaataccgcataagcgcacagcttcgcatggagcagtgcgaaaagatttatcggtgtgagatggacccgcgtctgattagctagttggtggggtaacggcctaccaaggcaacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggacgaagcggagttcgaaagaactccattgacggtacctgactaagaagccccggctaactacgtgccagcagccgcggtaatacgtagggggcaagcgttatccggatttactgggtgtaaagggagcgtagacggtgatgtaagtcagatgtgaaagcccggggctcaaccccgggactgcatttgaaactatgttgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttgggggtcaaaagaccttcggtgccgtcgcaaacgcattaagtattccacctggggagtacgttcgcaagaatgaaactcaaaggaattgacggggacccgcacaagcggtggagcatgtggtttaattcgaagcaacgcgaagaaccttaccaggtcttgacatccccctgaccggtccgtaacggggcctttccttcgggacaggggagacaggtggtgcatggttgtcgtcagctcgtgtcgtgagatgttgggttaagtcccgcaacgagcgcaacccttatccttagtagccagcatgtaaagatgggcactctagggagactgccagggataacctggaggaaggcggggatgacgtcaaatcatcatgccccttatgatctgggctacacacgtgctacaatggtgactacaaagggaagcagccctgtgaaggtgagcaaatcccaaaaaggtcatctcagttcggattgtagtctgcaactcgactacatgaagctggaatcgctagtaatcgcgaatcag

SEQ ID NO: 1388 - DNA, 1525 bp, Anaerofustis stercorihominis
  ref <308>: DATABASE ACCESSION NUMBER: NCBI ACCESSION: NZ_QUSM01000007.1
  ref <309>: DATABASE ENTRY DATE: 2019-04-01
  ref <313>: RELEVANT RESIDUES IN SEQ ID NO: (1)..(1525)
ttattttgagagtttgatcctggctcaggacgaacgctggcggcgtgcttaacacatgcaagtcgaacgagaagcttataaatgatccttcgggtgaagctataagcggacagtggcgaacgggtgagtaacgcgtaggtaaccaacctcatgcagggggatagcccagggaaacttggattaaacccgcataagaccacagcaccgcatggtgcaggggtaaaaactccggtggcatgagacggacctgcgtcttattaggtagttggtgaggtaacggctcaccaagccaacgatgagtagccgacctgagagggtgatcggccacattgggactgagacacggcccagactcctacgggaggcagcagtggggaatattgcgcaatgggggaaaccctgacgcagcaacgccgcgtgagcgatgaaggttttcggatcgtaaagctctgtctttggggaagataatgacggtacccaaggaggaagctccggctaactacgtgccagcagccgcggtaatacgtagggagcaagcgttgtccggattcactgggcgtaaagagcacgtaggcggttaattaagtcaggtgtgaaagttttcggctcaaccggaaaagtgcacttgaaactggataacttgagtatcggagaggtaagcggaattcctagtgtagcggtgaaatgcgtagagattaggaagaacaccggtggcgaaggcggcttactggacgataactgacgctgaggtgcgaaagcgtggggagcgaacaggattagataccctggtagtccacgccgtaaacgatgaatactaggtgttggggtaactcagtgccgcagttaacacattaagtattccgcctggggagtacgctcgcaagagtgaaactcaaaggaattgacgggggcccgcacaagcagcggagcatgtggtttaattcgaagcaacgcgaagaaccttaccaggtcttgacatcccttgaccgcctaagagattaggctttccttcgggacaaggagacaggtggtgcatggttgtcgtcagctcgtgtcgtgagatgttgggttaagtcccgcaacgagcgcaacccttatgtttagttactaacattcagttgaggactctagacagactgcccttgaaagagggaggaaggtggggacgacgtcaaatcatcatgccccttacgacctgggctacacacgtgctacaatggtctgtacagagggttgcgaagcagtgatgctaagctaatctcaaaaagcagatctcagttcggattgcaggctgcaactcgcctgcatgaagtcggagttgctagtaatcgcgaatcagaatgtcgcggtgaatgcgttcccgggccttgtacacaccgcccgtcacaccacgagagttggtaacacccgaagccagtgagctaaccattaggaggcagctgtcgaaggtgggatcagtaattggggtgaagtcgtaacaaggtagccgtatcggaaggtgcggctggatcacctcctttctaag

SEQ ID NO: 1389 - DNA, 1320 bp, Anaeroglobus geminatus
  ref <308>: DATABASE ACCESSION NUMBER: NCBI ACCESSION: NZ_JH417596.1
  ref <309>: DATABASE ENTRY DATE: 2019-04-01
  ref <313>: RELEVANT RESIDUES IN SEQ ID NO: (1)..(1320)
atggagagtttgatcctggctcaggacaacgctggcggcgtgcgtaacacatgcaagtcgaacgagagagtgagagaagcttgcttttcttacaatcgagtggcaaacgggtgagtaacgcgtaaacaacctgccccgcagatggggacaacagctggaaacggctgctaataccgaatacggtcctcttagcgcatggtaagaggaagaaagggtggcctctggaacaagctaccgctgtgggaggggtttgcgtctgattagctggttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttataggggacgaacggccgggtagcgaagagggagccggcatgacggtaccgtaagagaaagccacggctaactacgtgccagcagccgcggtaatacgtaggtggcaagcgttgtccggaatgattgggcgtaaagggcgcttggcggctgtgtaagtctgtctagaaagtgcggggctaaaccccgtgagaggatggaaactggacagctgagagtgtcggagaggaaagcggaattcctagtgtagcggtgaaatgcgtagatattaggaggaacaccggtggcgaaagcggctttctggacgacaactgacgctgaggcgcgaaagccaggggagcaaacgggattagataccccggtagtcctggccgtaaacgatgggtactaggtgtaggaggtatcgacccctcctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccaagccttgacattgctcgcaacgggtagagatacctggttcttcttcggaagacgagacaacaggtggtgcacggctgtcgtcagctcgtgtcgtgagatgttgggttaagtcccgcaacgagcgcaacccctatcttcagttaccagcacgtagaggtggggactcaggagagactgccgcagacaatgcggaggaaggcggggacgacgtcaagtcatcatgccccttatggcttgggctacacacgtactacaatggctctaaatagagggaagcgaaggagcgatccggagcaaaccccgcaaacagagtccc

SEQ ID NO: 1390 - DNA, 1519 bp, Anaeromassilibacillus sp. Marseille-P3876
  ref <308>: DATABASE ACCESSION NUMBER: NCBI ACCESSION: NZ_OLMR01000018.1
  ref <309>: DATABASE ENTRY DATE: 2019-04-01
  ref <313>: RELEVANT RESIDUES IN SEQ ID NO: (1)..(1519)
tttttgagagtttgatcctggctcaggacgaacgctggcggcgtgcctaacacatgcaagtcgaacgaagctttgaggagcttgctttttaaagcttagtggcggacgggtgagtaacgcgtgagcaacctgcctctcagagggggataacgttttgaaaagaacgctaataccgcataacatatcggaaccgcatgattctgatatcaaaggagcaatccgctgagagatgggctcgcgtccgattagttagttggtgaggtaacggctcaccaagactacgatcggtagccggactgagaggttgatcggccacattgggactgagacacggcccagactcctacgggaggcagcagtgggggatattgcgcaatgggggaaaccctgacgcagcaacgccgcgtgaaggaagaaggtcttcggattgtaaacttcttttgtcagggacgaagaaagtgacggtacctgacgaataagctccggctaactacgtgccagcagccgcggtaatacgtagggagcgagcgttgtccggatttactgggtgtaaagggtgcgtaggcggccgagcaagtcagttgtgaaaactatgggcttaacccataacgtgcaattgaaactgtccggcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcctgagaatccttaagagattagggagtgccttcgggaactcagagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggccattaacagagggaagcaaaaccgcgaggcagagcaaacccctaaaaatggtcccagttcggattgtaggctgcaacccgcctacatgaagttggaattgctagtaatcgcggatcagcatgccgcggtgaatacgttcccgggccttgtacacaccgcccgtcacaccatgggagccggtaatacccgaagtcagtagtctaacagcaatgaggacgctgccgaaggtaggattggcgactggggtgaagtcgtaacaaggtagccgtatcggaaggtgcggctggatcacctcctttcta

SEQ ID NO: 1391 - DNA, 1521 bp, Anaeromassilibacillus sp. Marseille-P4683
  ref <308>: DATABASE ACCESSION NUMBER: NCBI ACCESSION: NZ_OCTT01000008.1
  ref <309>: DATABASE ENTRY DATE: 2019-04-01
  ref <313>: RELEVANT RESIDUES IN SEQ ID NO: (1)..(1521)
ttttagagagtttgatcctggctcaggacgaacgctggcggcgtgcctaacacatgcaagtcgaacggacgagaaggtgcttgcaccttcaagttagtggcggacgggtgagtaacgcgtgagcaacctgcctcaaagagggggataacgtctggaaacggacgctaataccgcatgacgtattcgataggcatctattggataccaaaggagcaatccgctttgagatgggctcgcgtctgattagctagttggtggggtaaaggcctaccaaggcgacgatcagtagccggactgagaggttgaacggccacattgggactgagacacggcccagactcctacgggaggcagcagtgggggatattgcacaatgggggaaaccctgatgcagcaacgccgcgtgaaggaagacggttttcggattgtaaacttctgttcttagtgacgataatgacggtagctaaggagaaagctccggctaactacgtgccagcagccgcggtaatacgtagggagcgagcgttgtccggaattactgggtgtaaagggagcgtaggcgggagatcaagtcagatgtgaaaactatgggctcaacccataacctgcatttgaaactgttcttcttgagtgaagtagaggcaggcggaattccgagtgtagcggtgaaatgcgtagatattcggaggaacaccagtggcgaaggcggcctgctgggcttttactgacgctgaggctcgaaagcatggggagcaaacaggattagataccctggtagtccatgccgtaaacgatgattactaggtgtggggtggctgacccattccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccgactaacgaagtagagatacattaggtgcccttcggggaaagtcgagacaggtggtgcatggttgtcgtcagctcgtgtcgtgagatgttgggttaagtcccgcaacgagcgcaacccttgtcattagttgctacgcaagagcactctaatgagactgccgttgacaaaacggaggaaggtggggacgacgtcaaatcatcatgccccttatgacctgggctacacacgtactacaatggccgttaacagagggaagcaatactgtgaagtggagcaaacccctaaaaacggtcccagttcagattgcaggctgcaacccgcctgcatgaagtcggaattgctagtaatcgcggatcagcatgccgcggtgaatacgttcccgggccttgtacacaccgcccgtcacaccatgggagccggtaatacccgaagtcggtagtctaaccgcaaggaggacgccgccgaaggtaggattggcgactggggtgaagtcgtaacaaggtagccgtatcggaaggtgcggctggatcacctcctttctaagga

SEQ ID NO: 1392 - DNA, 439 bp, Anaeromusa acidaminophila
  ref <308>: DATABASE ACCESSION NUMBER: NCBI ACCESSION: NZ_KB894583.1
  ref <309>: DATABASE ENTRY DATE: 2019-04-01
  ref <313>: RELEVANT RESIDUES IN SEQ ID NO: (1)..(439)
ttttatcggagagtttgatcctggctcaggacgaacgctggcggcgtgcttaacacatgcaagtcgaacggtccagaatttaacaccgagaacatactgcttgggaaagccgagcggtggcgagtaaaacgagccaccacacatacataaagtgattaccaaataggtgttttgggtgttaaattctggatagtggcgaacgggtgagtaacgcgtaggcaatctgccttctagatggggacaacatcccgaaaggggtgctaataccgaatgttgtaccgggtccgcatggacaagatactaaaggtggcctctgaatatgctaccgctagaagatgagcctgcgtctgattagctagttggaggggtaacggcccaccaaggcttcgatcagtagccggtctgagaggatgaacggccacactgggactgagacacg

SEQ ID NO: 1393 - DNA, 1539 bp, Anaerosphaera sp. GS7-6-2
  ref <308>: DATABASE ACCESSION NUMBER: NCBI ACCESSION: NZ_RLIH01000038.1
  ref <309>: DATABASE ENTRY DATE: 2019-04-01
  ref <313>: RELEVANT RESIDUES IN SEQ ID NO: (1)..(1539)
tttaattgagagtttgatcctggctcaggacgaacgctggcggcgcgcctaacacatgcaagtcgagcgatgaaagaacgcctaaacccttcggggtgaagatgttctggattagcggcggacgggtgagtaacacgtgagtaacctgcctttgacatggggatagcctcgggaaactgtgattaatacccaatgaaattacaaattcgcatgaaaatgtaatcaaagcgtatagcggtcaaagatggactcgcgtctgattagctagttggtaaggtaacggcttaccaaggcaacgatcagtagccggcctgagagggtgaacggccacattggaactgagagacggtccaaactcctacgggaggcagcagtggggaatattgcacaatggagggaactctgatgcagcgacgccgcgtgagcgaagaaggttttcgaatcgtaaagctctgtcctatgggaagatagtgacggtaccataggaggaagccccggctaactacgtgccagcagccgcggtaatacgtagggggctagcgttgtccggaattactgggcgtaaagggttcgcaggcggaattgcaagtcatatgtgaaattcagaggcttaacctctgcaagcatgtgaaactgtaattcttgagatatggagaggtaagtggaattcctagtgtagcggtgaaatgcgtagatattaggaggaataccagtggcgaaggcgacttactggccataaactgacgctgaggaacgaaagcgtggggagcaaacaggattagataccctggtagtccacgccgtaaacgatgagtgctaggtgtcgggagtaatttcggtgccgtagttaacacaataagcactccgcctggggagtacgtacgcaagtatgaaactcaaaggaattgacggggacccgcacaagcagcggagcatgtggtttaattcgaagcaacgcgaagaaccttaccaagtcttgacatattattgaccggtatagagatatgcctttaccttcgggtacagtaatacaggtggtgcatggttgtcgtcagctcgtgtcgtgagatgttgggttaagtcccgcaacgagcgcaacccttacctttagttgccagcgcgtaaaggcgggaactctagagggactgccgatgataaatcggaggaaggtggggatgacgtcaaatcatcatgccctatatgacttgggctacacacgtgctacaatggtcggaacaaagagaagcgaaagggtgacctcaagcaaatctcaaaaagccgatcccagttcggattgttctctgcaactcgagaacatgaagtcggagttgctagtaatcgcaaatcagaatgttgcggtgaatgcgttcccgggtcttgtacacaccgcccgtcacaccatgggagttggcaatacccgaagcctgtgagccaacctgaaaagggggcagcagtcgaaggtagggttaatgactggggtgaagtcgtaacaaggtagccgtatcggaaggtgcggctggatcacctcctttctaagga

SEQ ID NO: 1394 - DNA, 635 bp, Anaerosporobacter mobilis
  ref <308>: DATABASE ACCESSION NUMBER: NCBI ACCESSION: NZ_FRCP01000002.1
  ref <309>: DATABASE ENTRY DATE: 2019-04-01
  ref <313>: RELEVANT RESIDUES IN SEQ ID NO: (1)..(635)
aaaccctgatccagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtaggtggcatggcaagtcagaagtgaaagcccagggctcaaccctgggactgcttttgaaactgtcaagctagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtctgggattcgattctcaggtgccgacgctaacgcattaagtattccacctggggagtacgttcgcaagaatgaaactcaaaggaattgacggggacccgcacaagcggtggagcatgtggtttaattcgaagcaacgcgaagaaccttacctagtcttgacatcccgatgaccggactttaatcggtccttctcttcggagcatcgg

SEQ ID NO: 1395 - DNA, 1556 bp, Anaerosporomusa subterranea
  ref <308>: DATABASE ACCESSION NUMBER: NCBI ACCESSION: NZ_LSGP01000002.1
  ref <309>: DATABASE ENTRY DATE: 2019-04-01
  ref <313>: RELEVANT RESIDUES IN SEQ ID NO: (1)..(1556)
ttggagagtttgatcctggctcaggacgaacgctggcggcgtgcctaacacatgcaagtcgaacgggggatagcaatatccctagtggcgaacgggtgagtaacgcgtagacaacctgccttctagacggggacaacgttccgaaaggagcgctaataccggatgaggtctttaggctgcatagcttaaagaagaaaggtggcctctatatataagctaccgctagaagatgggtctgcgtctgattagctagttggcggggtaacggcccaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggattgtaaagctctgtcttctgggaagaatggcttccatgtgaataatgtgggagcatgacggtactagaggaggaagccacggctaactacgtgccagcagccgcggtaatacgtaggtggcaagcgttgtccggaattattgggcgtaaagcgcgcgcaggcgggaatgtaagtctgtcttaaaagtgcggtgctcaacgccgtgatgggacagaaactatatttcttgagtgcaggagaggacagtggaattcccagtgtagcggtgaaatgcgtagatattgggaggaacaccagtggcgaaggcgactgtctggactgtgtctgacgctgaggcgcgaaagccagggtagtgaacgggattagataccccggtaatcctggccgtaaacgatgggtactaggtgttgggggtatcgacccctccagtgccggagttaacgcaataagtaccccgcctggggagtacggccgcaaggttgaaactcaaaggaattgacgggggcccgcacaagcggtggagtatgtggtttaattcgacgcaacgcgaagaaccttaccagggcttgacattgagtgaaagacctagagataggtccctcccttcggggacacaaaaacaggtggtgcatggctgtcgtcagctcgtgtcgtgagatgttgggttaagtcccgcaacgagcgcaacccttattctttgttgccagcatgtaatgatgggcactcaagggagactgccgtcgacaagacggaggaaggtggggatgacgtcaagtcatcatgccccttatgtcctgggctacacacgtactacaatgggcgtaaacagagggaagcaagaccgcgaggtggagccaatcccataaatacgctctcagttcggatcggaggctgcaactcgcctccgtgaagtcggaatcgctagtaatcgcagatcagcatgctgcggtgaatacgttcccgggccttgtacacaccgcccgtcacaccacgaaagttggaaacacccgaagccggtgggctaaccgcaaggaagcagccgtcgaaggtggggccgatgattggggtgaagtcgtaacaaggtagccgtatcggaaggtgcggctggatcacctcctttctagggaga

SEQ ID NO: 1396 - DNA, 1542 bp, Anaerostipes caccae
  ref <308>: DATABASE ACCESSION NUMBER: NCBI ACCESSION: NZ_UYXC01000048.1
  ref <309>: DATABASE ENTRY DATE: 2019-04-01
  ref <313>: RELEVANT RESIDUES IN SEQ ID NO: (1)..(1542)
gaacatgagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacagggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccctgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgaccgaaccttaaccggttttttctttcgagacattggagacaggtggtgcatggttgtcgtcagctcgtgtcgtgagatgttgggttaagtcccgcaacgagcgcaacccctatctttagtagccagcatttgaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccttaaggagggagctgccgaaggtgggaccgataactgaggtgaagtcgtaacaaggtagccgtatcggaaggtgcggctggatcacctcctttctaaggaa

SEQ ID NO: 1397 - DNA, 1541 bp, Anaerostipes hadrus
  ref <308>: DATABASE ACCESSION NUMBER: NCBI ACCESSION: NZ_CP012098.1
  ref <309>: DATABASE ENTRY DATE: 2019-04-01
  ref <313>: RELEVANT RESIDUES IN SEQ ID NO: (1)..(1541)
gaacatgagagtttgatcctggctcaggatgaacgctggcggcgtgcttaacacatgcaagtcgaacgaagctgcttaactgatcttcttcggaattgacgttttgtagactgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagtagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactagagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagctaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagtgacaggtggtgcatggttgtcgtcagctcgtgtcgtgagatgttgggttaagtcccgcaacgagcgcaacccctatctttagtagccagcatttcaggtgggcactctagagagactgccagggataacctggaggaaggtggggacgacgtcaaatcatcatgccccttatgaccagggctacacacgtgctacaatggcgtaaacaaagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 1398 - DNA, 1540 bp, Anaerostipes sp. 494a
  ref <308>: DATABASE ACCESSION NUMBER: NCBI ACCESSION: NZ_MJIF01000001.1
  ref <309>: DATABASE ENTRY DATE: 2019-04-01
  ref <313>: RELEVANT RESIDUES IN SEQ ID NO: (1)..(1540)
aacatgagagtttgatcctggctcaggatgaacgctggcggcgtgcttaacacatgcaagtcgaacgaagcacttgagactgattctttcgggatgacgtttcttgtgactgagtggcggacgggtgagtaacgcgtgggtaacctgccttatacagggggataacagttagaaatgactgctaataccgcataagaccacggtaccgcatggtacagtggtaaaaactgaggtggtataagatggacccgcgtctgattagctagttggtgaggtaacggctctaccaaggcaacgatcagtagccggcttgagagagtggacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccggggcttaactccgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagctaacgcaataagtattccacctggggagtacgttcgcaagaatgaaactcaaaggaattgacggggacccgcacaagcggtggagcatgtggtttaattcgaagcaacgcgaagaaccttacctggtcttgacatcctcttgaccgtcccttaatcgggattttccttcgggacaggagtgacaggtggtgcatggttgtcgtcagctcgtgtcgtgagatgttgggttaagtcccgcaacgagcgcaacccctatctttagtagccagcagtgagatgggcactctagagagactgccagggataacctggaggaaggtggggacgacgtcaaatcatcatgccccttatgaccagggctacacacgtgctacaatggcgtaaacagagggaagcgagactgcgaggtggagcaaatcccaaaaataacgtcacagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 1399 - DNA, 1541 bp, Anaerostipes sp. 992a
  ref <308>: DATABASE ACCESSION NUMBER: NCBI ACCESSION: NZ_MJIG01000003.1
  ref <309>: DATABASE ENTRY DATE: 2019-04-01
  ref <313>: RELEVANT RESIDUES IN SEQ ID NO: (1)..(1541)
tttaacatgagagtttgatcctggctcaggatgaacgctggcggcgtgcttaacacatgcaagtcgaacgaagcgctccggacgattctttcgggatgagactggagggactgagtggcggacgggtgagtaacgcgtgggtaacctgcctcatacagggggataacagtcagaaatggctgctaataccgcataagcgcacagtaccgcatggtacggtgtgaaaaactccggtggtatgagatggacccgcgtctgattagctggttggcagggtaacggcctaccaaggcgacgatcagtagccggcttgagagagtggacggccacattgggactgagacacggcccagactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtacggcaagtcagaagtgaaagcccggggctcaactccgggactgcttttgaaactgtcggactggagtgcaggagaggtaagcggaattcctagtgtagcggtgaaatgcgtagatattaggaggaacaccagtggcgaaggcggcttactggactgtcactgacactgaggcacgaaagcgtggggagcaaacaggattagataccctggtagtccacgccgtaaacgatgaatactaggtgtcggggccgcagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcctccggaccggcccgtaacggggcctttccttcgggactggagagacaggtggtgcatggttgtcgtcagctcgtgtcgtgagatgttgggttaagtcccgcaacgagcgcaacccttatctttagtagccagcattatggatgggcactctagagagactgccagggataacctggaggaaggtggggatgacgtcaaatcatcatgccccttatggccagggctacacacgtgctacaatggtggtaacagagtgaagcaaacccgcgagggggagcaaatcacaaaaatgccatctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttctaaggaa

SEQ ID NO: 1400 - DNA, 1542 bp, Anaerostipes sp. AF04-45
  ref <308>: DATABASE ACCESSION NUMBER: NCBI ACCESSION: NZ_QTXQ01000008.1
  ref <309>: DATABASE ENTRY DATE: 2019-04-01
  ref <313>: RELEVANT RESIDUES IN SEQ ID NO: (1)..(1542)
gaacatgagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacagggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgaccgaaccttaaccggttttttctttcgagacattggagacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctcctttctaaggaa

SEQ ID NO: 1401 - DNA, 1528 bp, Anaerotruncus colihominis
  ref <308>: DATABASE ACCESSION NUMBER: NCBI ACCESSION: NZ_QVME01000002.1
  ref <309>: DATABASE ENTRY DATE: 2019-04-01
  ref <313>: RELEVANT RESIDUES IN SEQ ID NO: (1)..(1528)
ttatcaaagagtttgatcctggctcaggacgaacgctggcggcgcgcctaacacatgcaagtcgaacggagcttacgttttgaagttttcggatggacgaatgtaagcttagtggcggacgggtgagtaacacgtgagcaacctgcctttcagagggggataacagccggaaacggctgctaataccgcatgatgttgcgggggcacatgcccctgcaaccaaaggagcaatccgctgaaagatgggctcgcgtccgattagccagttggcggggtaacggcccaccaaagcgacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtctttggggaagaaaatgacggtacccaaagaggaagctccggctaactacgtgccagcagccgcggtaatacgtagggagcaagcgttgtccggaattactgggtgtaaagggagcgtaggcgggatggcaagtagaatgttaaatccatcggctcaaccggtggctgcgttctaaactgccgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcatagcctagagataggtgaagcccttcggggcatccagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcactaaaacagagggcggcgacaccgcgaggtgaagcgaatcccgaaaaagtgtctcagttcagattgcaggctgcaacccgcctgcatgaagtcggaattgctagtaatcgcggatcagcatgccgcggtgaatacgttcccgggccttgtacacaccgcccgtcacaccatgggagtcggtaacacccgaagccagtagcctaaccgcaaggggggcgctgtcgaaggtgggattgatgactggggtgaagtcgtaacaaggtagccgtatcggaaggtgcggctggatcacctcctttcta

SEQ ID NO: 1402 - DNA, 1524 bp, Anaerotruncus massiliensis
  ref <308>: DATABASE ACCESSION NUMBER: NCBI ACCESSION: NZ_LT962687.1
  ref <309>: DATABASE ENTRY DATE: 2019-04-01
  ref <313>: RELEVANT RESIDUES IN SEQ ID NO: (1)..(1524)
caaagagtttgatcctggctcaggacgaacgctggcggcgcgcctaacacatgcaagtcgaacggagtgttttcacggaagttttcggatggaagtggttacacttagtggcggacgggtgagtaacacgtgagcaacctgcctttcagagggggataacagttggaaacgactgctaataccgcatgatattaccgggtcacatggcctggcaatcaaaggagcaatccgctgaaagatgggctcgcgtccgattagccagttggcggggtaatggcccaccaaagcgacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtcttaggggaagaaaatgacggtaccctaagaggaagctccggctaactacgtgccagcagccgcggtaatacgtagggagcgagcgttgtccggaattactgggtgtaaagggagcgtaggcgggatgccaagtagaatgttaaatccatcggctcaactggtggcagcgttctaaactggcgttcttgagtgaggtagaggcaggcggaattcctagtgtagcggtgaaatgcgtagatattaggaggaacaccagtggcgaaggcggcctgctgggccttaactgacgctgaggctcgaaagcgtggggagcaaacaggattagataccctggtagtccacgccgtaaacgatgaatcctaggtgtggggggactgacaccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcataccatagagatatgggaagcccttcggggcatccagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcactcaaacagagggaagcgacaccgcgaggtgaagcggatcccaaaaaagtgtctcagttcggatcgcaggctgcaacccgcctgcgtgaagtcggaattgctagtaatcgcggatcagcatgccgcggtgaatacgttcccgggccttgtacacaccgcccgtcacaccatgggagtcggtaacacccgaagccagtagcctaaccgcaaggagggcgctgtcgaaggtgggattgatgactggggtgaagtcgtaacaaggtagccgtatcggaaggtgcggctggatcacctcctttcta

SEQ ID NO: 1403 - DNA, 1528 bp, Anaerotruncus rubiinfantis
  ref <308>: DATABASE ACCESSION NUMBER: NCBI ACCESSION: NZ_FKLA01000009.1
  ref <309>: DATABASE ENTRY DATE: 2019-04-01
  ref <313>: RELEVANT RESIDUES IN SEQ ID NO: (1)..(1528)
aacaaagagtttgatcctggctcaggacgaacgctggcggcgcgcctaacacatgcaagtcgaacggagtttatccgactgaagttttcggatggaagatggataaacttagtggcggacgggtgagtaacacgtgagcaacctgcctttcagagggggataacgattggaaacgatcgctaataccgcataacattatgaggagacatcttcttataatcaaaggagcaatccgctgaaagatgggctcgcggccgattagctagatggtggggtaacggcccaccatggcgacgatcggtagccggactgagaggttgaacggccacattgggactgagacacggcccagactcctacgggaggcagcagtgggggatattgcacaatggaggaaactctgatgcagcgacgccgcgtgagggaagacggtcttcggattgtaaacctctgtcttaggggaagaaaatgacggtaccctaagaggaagctccggctaactacgtgccagcagccgcggtaatacgtagggagcgagcgttgtccggaattactgggtgtaaagggagcgtaggcgggatggcaagttggatgtttaaactaacggctcaactgttaggtgcatccaaaactgctgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcataccatagagatatgggaagtccttcgggacatccagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcacttaaacaaagggcagcaacgtcgcgaggcgaagcgaatcccgaaaaagtgtctcagttcggatcgcaggctgcaacccgcctgcgtgaagtcggaattgctagtaatcgcggatcagcatgccgcggtgaatacgttcccgggccttgtacacaccgcccgtcacaccatgggagtcggtaacacccgaagccagtagtctaactgcaaagaggacgctgtcgaaggtgggattgatgactggggtgaagtcgtaacaaggtagccgtatcggaaggtgcggctggatcacctcctttcta

SEQ ID NO: 1404 - DNA, 1541 bp, Anaerotruncus sp. 1XD22-93
  ref <308>: DATABASE ACCESSION NUMBER: NCBI ACCESSION: NZ_RAZK01000285.1
  ref <309>: DATABASE ENTRY DATE: 2019-04-01
  ref <313>: RELEVANT RESIDUES IN SEQ ID NO: (1)..(1541)
tttttatgagagtttgatcctggctcaggatgaacgctggcggcgtgcttaacacatgcaagtcgagcggagcacatcattggaatccttcgggaggaagaggatgtggcttagcggcggacgggtgagtaacgcgtggacaacctgccctatgcagggggataacatccggaaacgggtgctaataccgcataagcgcacagtaccgcatggtacggtgtgaaaagctgaggcggcataggatgggtccgcgttggattaggcagttggcggggtaacggcccaccaaaccgacgatccatagccggcctgagagggtggacggccacattgggactgagacacggcccagactcctacgggaggcagcagtggggaatattgcacaatggggggaaccctgatgcagcgacgccgcgtgggtgaggaagtacttcggtatgtaaagccctatcagcagggaagaaaatgacggtacctgactaagaagccccggctaactacgtgccagcagccgcggtaatacgtagggggcaagcgttatccggatttactgggtgtaaagggagcgtagacggcgtgccaagtctgatgtgaaaggccggggctcaaccccgggactgcattggaaactggcatgctggagtgccggaggggcaagcggaattcctagtgtagcggtgaaatgcgtagatattaggaggaacaccggtggcgaaggcggcttgctggacggtaactgacgttgaggctcgaaagcgtggggagcaaacaggattagataccctggtagtccacgccgtaaacgatgaatgctaggtgtcgggggacatggtcttccggtgccgccgcaaacgcagtaagcattccacctggggagtacgttcgcaagaatgaaactcaaaggaattgacggggacccgcacaagcggtggagcatgtggtttaattcgaagcaacgcgaagaaccttaccaggccttgacatcccgctgacaggatagtaatgtatccgtcccttcggggcagtggagacaggtggtgcatggttgtcgtcagctcgtgtcgtgagatgttgggttaagtcccgcaacgagcgcaacccttaccttcagtagccagcacataatggtgggcactctggagggactgccggggacaacccggaggaaggtggggacgacgtcaaatcatcatgccccttatggcctgggctacacacgtgctacaatggcgtaaacagagggaggcagccccgcgagggtgagcaaaccccaaaaataacgtcccagttcggattgcagtctgcaactcgactgcatgaagctggaatcgctagtaatcgcggatcagaatgccgcggtgaatacgttcccgggtcttgtacacaccgcccgtcacaccatgggagttggtaacgcccgaagtcagtgacctaaccgaaagggaggagctgccgaaggtgggaccagtgactggggtgaagtcgtaacaaggtagccgtatcggaaggtgcggctggatcacctcctttctaaggaa

SEQ ID NO: 1405 - DNA, 1528 bp, Anaerotruncus sp. AF02-27
  ref <308>: DATABASE ACCESSION NUMBER: NCBI ACCESSION: NZ_QSBX01000003.1
  ref <309>: DATABASE ENTRY DATE: 2019-04-01
  ref <313>: RELEVANT RESIDUES IN SEQ ID NO: (1)..(1528)
aacaaagagtttgatcctggctcaggacgaacgctggcggcgcgcctaacacatgcaagtcgaacggagtttatccgactgaagttttcggatggaagatggataaacttagtggcggacgggtgagtaacacgtgagcaacctgcctttcagagggggataacgattggaaacgatcgctaataccgcataacattatgaggagacatcttcttataatcaaaggagcaatccgctgaaagatgggctcgcggccgattagctagatggcggggtaacggcccaccatggcgacgatcggtagccggactgagaggttgaacggccacattgggactgagacacggcccagactcctacgggaggcagcagtgggggatattgcacaatggaggaaactctgatgcagcgacgccgcgtgagggaagacggtcttcggattgtaaacctctgtcttaggggaagaaaatgacggtaccctaagaggaagctccggctaactacgtgccagcagccgcggtaatacgtagggagcgagcgttgtccggaattactgggtgtaaagggagcgtaggcgggatggcaagttggatgtttaaactaacggctcaactgttaggtgcatccaaaactgctgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcataccatagagatatgggaagtccttcgggacatccagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcacttaaacaaagggcagcaacgtcgcgaggcgaagcgaatcccgaaaaagtgtctcagttcggatcgcaggctgcaacccgcctgcgtgaagtcggaattgctagtaatcgcggatcagcatgccgcggtgaatacgttcccgggccttgtacacaccgcccgtcacaccatgggagtcggtaacacccgaagccagtagtctaactgcaaagaggacgctgtcgaaggtgggattgatgactggggtgaagtcgtaacaaggtagccgtatcggaaggtgcggctggatcacctcctttcta

SEQ ID NO: 1406 - DNA, 1477 bp, Anaerovibrio lipolyticus
  ref <308>: DATABASE ACCESSION NUMBER: NCBI ACCESSION: NZ_FQYW01000002.1
  ref <309>: DATABASE ENTRY DATE: 2019-04-01
  ref <313>: RELEVANT RESIDUES IN SEQ ID NO: (1)..(1477)
tgttggaaatggattctagtggcaaacgggtgagtaacgcgtaggcaacctgcccttcagatggggacaacatttcgaaaggaatgctaataccgaatgacgtgcattggtcgcatgaccgatgtaccaaaggccgggcaaccggtcactgaaggatgggcctgcgtctgattagctagttggtggggtaacggcccaccaaggcgacgatcagtagccggtctgagaggatgaacggccacattgggactgagacacggcccaaactcctacgggaggcagcagtggggaatcttccgcaatgggcgcaagcctgacggagcaacgccgcgtgagtgaagaaggttttcggatcgtaaagctctgttgtcagggacgagagacttgatcaggaaatgggtcaaggaggacggtacctgacgagaaagccacggctaactacgtgccagcagccgcggtaatacgtaggtggcgagcgttgtccggaattattgggcgtaaagggagcgcaggtgggattgtaagtcagtcttaaaagttcggggctcaaccccgtgatgggattgaaactataattcttgagtgcaggagaggaaagcggaattcctagtgtagcggtgaaatgcgtagatattaggaggaacaccagtggcgaaggcggctttctggactgtaactgacactgaggctcgaaagcgtggggagcgaacaggattagataccctggtagtccacgccgtaaacgatgaatgctaggtgtaggaggtatcgaccccttctgtgccggagttaacgcaataagcattccgcctggggagtacggtcgcaagactgaaactcaaaggaattgacgggggcccgcacaagcggtggagtatgtggtttaattcgacgcaacgcgaagaaccttaccaggtcttgacattgagtgaaagacatagagatatgtcccttcttcggaacacgaaaacaggtggtgcatggctgtcgtcagctcgtgtcgtgagatgttgggttaagtcccgcaacgagcgcaacccctgtcctgtgttgccagcacgtaatggtgggaactcacaggagactgccgcggagaacgcggaggaaggcggggatgacgtcaagtcatcatgccccttatgacctgggctacacacgtactacaatggggcgtacagagggcagcgaaggagcgatccggagcgaatcccaaaaaacgcctcccagttcggattgcaggctgaaacccgcctgcatgaagtcggaatcgctagtaatcgcaggtcagcatactgcggtgaatacgttcccgggccttgtacacaccgcccgtcacaccacggaagtcattcacacccgaagccggtgggctaaccgcaaggaagcagccgtctaaggtgggggcgatgactggggtgaagtcgtaacaaggtagccgtatcggaaggtgcggctggatcacctcctttctaaggag

SEQ ID NO: 1407 - DNA, 1462 bp, Anaerovibrio sp. JC8
  ref <308>: DATABASE ACCESSION NUMBER: NCBI ACCESSION: NZ_ANBM01000026.1
  ref <309>: DATABASE ENTRY DATE: 2019-04-01
  ref <313>: RELEVANT RESIDUES IN SEQ ID NO: (1)..(1462)
ttagtggcaaacgggtgagtaacgcgtaggcaacctgcccttcagatggggacaacatttcgaaaggaatgctaataccgaatgacgtgcattggtcgcatgaccgatgcaccaaaggccgggcaaccggtcactgaaggatgggcctgcgtctgattagctagttggtggggtaacggcccaccaaggcgacgatcagtagccggtctgagaggatgaacggccacattgggactgagacacggcccaaactcctacgggaggcagcagtggggaatcttccgcaatgggcgaaagcctgacggagcaacgccgcgtgagtgaagaaggttttcggatcgtaaagctctgttgtcagggacgagagacttattcaggaaatgggataaggaggacggtacctggcgagaaagccacggctaactacgtgccagcagccgcggtaatacgtaggtggcgagcgttgtccggaattattgggcgtaaagggagcgcaggtgggattgtaagtcagtcttaaaagttcggggctcaaccccgtgatgggattgaaactacaattcttgagtgcaggagaggaaagcggaattcctagtgtagcggtgaaatgcgtagatattaggaggaacaccagtggcgaaggcggctttctggactgtaactgacactgaggctcgaaagcgtggggagcgaacaggattagataccctggtagtccacgccgtaaacgatgaatgctaggtgtaggaggtatcgaccccttctgtgccggagttaacgcaataagcattccgcctggggagtacggtcgcaagactgaaactcaaaggaattgacgggggcccgcacaagcggtggagtatgtggtttaattcgacgcaacgcgaagaaccttaccaggtcttgacattaagtgaaagcccaagagattgggcccttcttcggaacacgaaaacaggtggtgcatggctgtcgtcagctcgtgtcgtgagatgttgggttaagtcccgcaacgagcgcaacccctgtcctgtgttgccagcatgtaaagatgggaactcacaggagactgccgcggagaacgcggaggaaggcggggatgacgtcaagtcatcatgccccttatgacctgggctacacacgtactacaatggggcgtacagagggcagcgaaggagcgatccggagcgaatcccaaaaaacgcctcccagttcggattgcaggctgaaacccgcctgcatgaagtcggaatcgctagtaatcgcaggtcagcatactgcggtgaatacgttcccgggccttgtacacaccgcccgtcacaccacggaagtcattcacacccgaagccggtgggctaaccgcaaggaagtagccgtctaaggtgggggcgatgactggggtgaagtcgtaacaaggtagccgtatcggaaggtgcggctggatcacctcctttctaaggag

SEQ ID NO: 1408 - DNA, 497 bp, Anaerovibrio sp. RM50
  ref <308>: DATABASE ACCESSION NUMBER: NCBI ACCESSION: NZ_KK211383.1
  ref <309>: DATABASE ENTRY DATE: 2019-04-01
  ref <313>: RELEVANT RESIDUES IN SEQ ID NO: (1)..(497)
ttttttggagagtttgatcctggctcaggacgaacgctggcggcgtgcttaacacatgcaagtcgaacgggaagacatttctaacaccgagtaactgagtagatgactgtcactgagacagcgtcgtgaggccccccgaaaacagagcctcaccacactttatttagtgattaacacttagagactgggtgttagaaatggattctagtggcaaacgggtgagtaacgcgtaggcaacctgcccttcagatggggacaacatttcgaaaggaatgctaataccgaatgacgtgcattggtcgcatgaccgatgtaccaaaggccgggcaaccggtcactgaaggatgggcctgcgtctgattagctagttggtggggtaacggcccaccaaggcgacgatcagtagccggtctgagaggatgaacggccacattgggactgagacacggcccaaactcctacgggaggcagcagtggggaatcttccgcaatgggcg

SEQ ID NO: 1409 - DNA, 1511 bp, Anaplasma centrale
  ref <308>: DATABASE ACCESSION NUMBER: NCBI ACCESSION: NC_013532.1
  ref <309>: DATABASE ENTRY DATE: 2019-04-01
  ref <313>: RELEVANT RESIDUES IN SEQ ID NO: (1)..(1511)
ttttaatcaaacttgagagtttgatcctggctcagaacgaacgctggcggcaagcttaacacatgcaagtcgaacggaccatacgcgcagcttgctgcgtgtatggttagtggcagacgggtgagtaatgcataggaatctacctagtagtataggatagccactagaaatggtgggtaatactgtataatccctgcgggggaaagatttatcgctattagatgagcctatgtcagattagctagttggtggggtaatggcctaccaaggcggtgatctgtagctggtctgagaggatgatcagccacactggaactgagacacggtccagactcctacgggaggcagcagtggggaatattggacaatgggcgcaagcctgatccagctatgccgcgtgagtgaggaaggccttagggttgtaaaactctttcagtagggaagataatgacggtacctacagaagaagtcccggcaaactccgtgccagcagccgcggtaatacggagggggcaagcgttgttcggaattattgggcgtaaagggcatgtaggcggtttggtaagttaaaggtgaaataccagggcttaaccctggggctgcttttaatactgcaggactagagtccggaagaggatagcggaattcctagtgtagaggtgaaattcgtagatattaggaggaacaccagtggcgaaggcggctgtctggtccggtactgacgctgaggtgcgaaagcgtggggagcaaacaggattagataccctggtagtccacgctgtaaacgatgagtgctgaatgtgggggcttttgcctctgtgttgtagctaacgcgttaagcactccgcctggggactacggtcgcaagactaaaactcaaaggaattgacggggacccgcacaagcggtggagcatgtggtttaattcgatgcaacgcgaaaaaccttaccacttcttgacatggaggctagatcttccttaacgggaaggcgcagttcggctgggcctcgcacaggtgctgcatggctgtcgtcagctcgtgtcgtgagatgttgggttaagtcccgcaacgagcgtaaccctcatccttagttaccagcgggtaatgccgggcactttaaggaaactgccagtgataaactggaggaaggtggggatgatgtcaagtcagcacggcccttatggggtgggctacacacgtgctacaatggcgactacaataggttgcaacgtcgcaaggctgagctaatccgtaaaagtcgtctcagttcggattgtcctctgtaactcgagggcatgaagtcggaatcgctagtaatcgtggatcagcatgccacggtgaatacgttctcgggtcttgtacacactgcccgtcacgccatgggaattggcttaactcgaagctggtgcgccaaccgtaaggaggcagccatttaaggttgggtcggtgactggggtgaagtcgtaacaaggtagctgtaggtgaacctgcggctggattacctccttt

SEQ ID NO: 1410 - DNA, 1506 bp, Anaplasma ovis
  ref <308>: DATABASE ACCESSION NUMBER: NCBI ACCESSION: NZ_PKOE01000001.1
  ref <309>: DATABASE ENTRY DATE: 2019-04-01
  ref <313>: RELEVANT RESIDUES IN SEQ ID NO: (1)..(1506)
tcaaacttgagagtctgatcctggctcagaacgaacgctggcggcaagcttaacacatgcaagtcgaacggaccgtatacgcagcttgctgcgtgtatggttagtggcagacgggtgagtaatgcataggaatctacctagtagtatgggatagccactagaaatggtgggtaatactgtataatccctgcgggggaaagatttatcgctattagatgagcctatgtcagattagctagttggtggggtaatggcctaccaaggcggtgatctgtagctggtctgagaggatgatcagccacactggaactgagacacggtccagactcctacgggaggcagcagtggggaatattggacaatgggcgcaagcctgatccagctatgccgcgtgagtgaggaaggccttagggttgtaaaactctttcagtagggaagataatgacggtacctacagaagaagtcccggcaaactccgtgccagcagccgcggtaatacggagggggcaagcgttgttcggaattattgggcgtaaagggcatgtaggcggtttggtaagttaaaggtgaaataccagggcttaaccctggggctgcttttaatactgcaggactagagtccggaagaggatagcggaattcctagtgtagaggtgaaattcgtagatattaggaggaacaccagtggcgaaggcggctgtctggtccggtactgacgctgaggtgcgaaagcgtggggagcaaacaggattagataccctggtagtccacgctgtaaacgatgagtgctgaatgtgggggcttttgcctctgtgttgtagctaacgcgttaagcactccgcctggggactacggtcgcaagactaaaactcaaaggaattgacggggacccgcacaagcggtggagcatgtggtttaattcgatgcaacgcgaaaaaccttaccacttcttgacatggaggctagatccttcttaacagaagggcgcagttcggctgggcctcgcacaggtgctgcatggctgtcgtcagctcgtgtcgtgagatgttgggttaagtcccgcaacgagcgcaaccctcatccttagttaccagcgggtaatgccgggcactttaaggaaactgccagtgataaactggaggaaggtggggatgatgtcaagtcagcacggcccttatggggtgggctacacacgtgctacaatggcgactacaataggttgcaacgtcgcaaggctgagctaatccgtaaaagtcgtctcagttcggattgtcctctgtaactcgagggcatgaagtcggaatcgctagtaatcgtggatcagcatgccacggtgaatacgttctcgggtcttgtacacactgcccgtcacgccatgggaattggcttaactcgaagctggtgcgccaaccgtaaggaggcagccatttaaggttgggtcggtgactggggtgaagtcgtaacaaggtagctgtaggtgaacctgcggctggattacctccttta

SEQ ID NO: 1411 - DNA, 1510 bp, Anaplasma phagocytophilum
  ref <308>: DATABASE ACCESSION NUMBER: NCBI ACCESSION: NZ_FLMD02000004.1
  ref <309>: DATABASE ENTRY DATE: 2019-04-01
  ref <313>: RELEVANT RESIDUES IN SEQ ID NO: (1)..(1510)
aatcaaacttgagagtttgatcctggctcagaacgaacgctggcggcaagcttaacacatgcaagtcgaacggattattctttatagcttgctataaagaataattagtggcagacgggtgagtaatgcataggaatctacctagtagtatgggatagccactagaaatggtgggtaatactgtataatccctgcgggggaaagatttatcgctattagatgagcctatgttagattagctagttggtagggtaaaggcctaccaaggcgatgatctatagctggtctgagaggatgatcagccacactggaactgagatacggtccagactcctacgggaggcagcagtggggaatattggacaatgggcgcaagcctgatccagctatgccgcgtgagtgaggaaggccttagggttgtaaaactctttcagtagggaagataatgacggtacctacagaagaagtcccggcaaactccgtgccagcagccgcggtaatacggagggggcaagcgttgttcggaattattgggcgtaaagggcatgtaggcggttcggtaagttaaaggtgaaatgccagggcttaaccctggagctgcttttaatactgccagacttgagtccgggagaggatagcggaattcctagtgtagaggtgaaattcgtagatattaggaggaacaccagtggcgaaggcggctatctggtccggtactgacgctgaggtgcgaaagcgtggggagcaaacaggattagataccctggtagtccacgctgtaaacgatgagtgctgaatgtggggattttttatctctgtgttgtagctaacgcgttaagcactccgcctggggactacggtcgcaagactaaaactcaaaggaattgacggggacccgcacaagcggtggagcatgtggtttaattcgatgcaacgcgaaaaaccttaccactccttgacatggagattagatccttcttaacggaagggcgcagttcggctggatctcgcacaggtgctgcatggctgtcgtcagctcgtgtcgtgagatgttgggttaagtcccgcaacgagcgtaaccctcatccttagttgccagcgggttaagccgggcactttaaggaaactgccagtggtaaactggaggaaggtggggatgatgtcaagtcagcacggcccttatggggtgggctacacacgtgctacaatggtgactacaataggttgcaatgtcgcaaggctgagctaatccgtaaaagtcatctcagttcggattgtcctctgcaactcgagggcatgaagtcggaatcgctagtaatcgtggatcagcatgccacggtgaatacgttctcgggtcttgtacacactgcccgtcacgccatgggaattggcttaactcgaagctggtgcgccaaccgaaaggaggcagccatttaaggttgggtcagtgactagggtgaagtcgtaacaaggtagctgtaggtgaacctgcggctggattacctccttt

SEQ ID NO: 1412 - DNA, 1490 bp, Ancylobacter aquaticus
  ref <308>: DATABASE ACCESSION NUMBER: NCBI ACCESSION: NZ_RXIO01000033.1
  ref <309>: DATABASE ENTRY DATE: 2019-04-01
  ref <313>: RELEVANT RESIDUES IN SEQ ID NO: (1)..(1490)
tcaacttgagagtttgatcctggctcagaacgaacgctggcggcaggcttaacacatgcaagtcgaacgccccgcaaggggagtggcagacgggtgagtaacacgtggggatctgcccaatggtacggaatagctctgggaaactggaaataataccgtatgagcccgcaaggggaaagatttatcgccattggatgaacccgcgtcggattagctagttggtgtggtaaaggcgcaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccgacgaagataatgacggtagtcggagaagaagccccggctaacttcgtgccagcagccgcggtaatacgaagggggctagcgttgttcggaatcactgggcgtaaagcgcacgtaggcggatatttaagtcaggggtgaaagcctggagctcaactccagaactgcccttgatactgggtatctcgagtccggaagaggtaagtggaactgcgagtgtagaggtgaaattcgtagatattcgcaagaacaccagtggcgaaggcggcttactggtccggtactgacgctgaggtgcgaaagcgtggggagcaaacaggattagataccctggtagtccacgccgtaaacgatggaggctagccgttggtgagcatgctcatcagtggcgcagctaacgcattaagcctcccgcctggggagtacggtcgcaagattaaaactcaaaggaattgacgggggcccgcacaagcggtggagcatgtggtttaattcgaagcaacgcgcagaaccttaccagcctttgacatgtcccggacggttaccagagatggtttcttctcttcggagccgggaacacaggtgctgcatggctgtcgtcagctcgtgtcgtgagatgttgggttaagtcccgcaacgagcgcaaccctcgcccttagttgccatcattaagttgggcactctagggggactgccggtgataagccgcgaggaaggtggggatgacgtcaagtcctcatggcccttacgggctgggctacacacgtgctacaatggcggtgacagtgggaagcgaacccgcgagggtaagcaaatctccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaa

SEQ ID NO: 1413 - DNA, 1497 bp, Ancylobacter sp. FA202
  ref <308>: DATABASE ACCESSION NUMBER: NCBI ACCESSION: NZ_KB904818.1
  ref <309>: DATABASE ENTRY DATE: 2019-04-01
  ref <313>: RELEVANT RESIDUES IN SEQ ID NO: (1)..(1497)
tcattcaacttgagagtttgatcctggctcagaacgaacgctggcggcaggcttaacacatgcaagtcgaacgccccgcaaggggagtggcagacgggtgagtaacacgtggggatctgcccaatggtacggaataatttcgggaaactgggactaataccgtatgagcccgcaaggggaaagatttatcgccattggatgaacccgcgtcggattagctagttggtgtggtaaaggcgcaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccgacgaagataatgacggtagtcggagaagaagccccggctaacttcgtgccagcagccgcggtaatacgaagggggctagcgttgttcggaatcactgggcgtaaagcgcacgtaggcggatatttaagtcaggggtgaaagcctggagctcaactccagaactgcccttgatactgggtatctcgagtccggaagaggtaagtggaactgcgagtgtagaggtgaaattcgtagatattcgcaagaacaccagtggcgaaggcggcttactggtccggtactgacgctgaggtgcgaaagcgtggggagcaaacaggattagataccctggtagtccacgccgtaaacgatggaggctagccgttggtgagcatgctcatcagtggcgcagctaacgcattaagcctcccgcctggggagtacggtcgcaagattaaaactcaaaggaattgacgggggcccgcacaagcggtggagcatgtggtttaattcgaagcaacgcgcagaaccttaccagcctttgacatgtcccggacggttaccagagatggtttcttctcttcggagccgggaacacaggtgctgcatggctgtcgtcagctcgtgtcgtgagatgttgggttaagtcccgcaacgagcgcaaccctcgcccttagttgccatcattaagttgggcactctagggggactgccggtgataagccgcgaggaaggtggggatgacgtcaagtcctcatggcccttacgggctgggctacacacgtgctacaatggcggtgacagtgggaagcgaacccgcgagggtaagcaaatctccaaaagccgtctcagttcggattgcactctgcaactcgagtgcatgaaggtggaatcgctagtaatcgcagatcagcacgctgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaagga

SEQ ID NO: 1414 - DNA, 1488 bp, Anderseniella sp. Alg231-50
  ref <308>: DATABASE ACCESSION NUMBER: NCBI ACCESSION: NZ_LT703003.1
  ref <309>: DATABASE ENTRY DATE: 2019-04-01
  ref <313>: RELEVANT RESIDUES IN SEQ ID NO: (1)..(1488)
aacttgagagtttgatcctggctcagaacgaacgctggcggcaggcttaacacatgcaagtcgaacgccccttcgggggagtggcagacgggtgagtaacgcgtgggaacctacctttcggtacggaacaacagttggaaacgactgctaataccgtatacgtccttcgggagaaagatttatcgccgatagaggggcccgcgttggattagcttgttggtgaggtaatggctcaccaaggcgacgatccatagctggtctgagaggatgatcagccacactgggacttagacacggcccagactcctacgggaggcagcagtggggaatattggacaatgggcgcaagcctgatccagccatgccgcgtgagtgatgacggccctagggttgtaaagctctttcagtggtgaagataatgacggtaaccacagaagaagccccggctaactccgtgccagcagccgcggtaatacggagggggcaagcgttgttcggaattactgggcgtaaagcgcgcgtaggcgggtctttaagtcagaggtgaaatcctggagctcaactccagaactgcctttgatactggagatcttgagtccggaagaggttagtggaattcccagtgtagaggtgaaattcgtagatattgggaagaacaccagtggcgaaggcggctaactggtccggtactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttacctacccttgacatcccgatcgcggttttcagagatgaattccttcagttaggctggatcggtgacaggtgctgcatggctgtcgtcagctcgtgtcgtgagatgttgggttaagtcccgcaacgagcgcaaccctcgcctttagttgccagcatttagttgggcactctagagggactgccggtgataagccggaggaaggtggggatgacgtcaagtcctcatggcccttacgggtagggctacacacgtgctacaatggcggtgacagtgggcagctacttcgcgagaagatgctaatcccaaaaaaccgtctcagttcggattgcactctgcaactcgagtgcatgaagttggaatcgctagtaatcgtagaacagcatgctacggtgaatacgttcccgggccttgtacacaccgcccgtcacaccatgggagttggttttaccttaagacggtgtgctaaccttcgggaggcagccggccacggtagggtcagcgactggggtgaagtcgtaacaaggtagccgtaggggaacctgcggctggatcacctcctttctaag

SEQ ID NO: 1415 - DNA, 1527 bp, Anditalea andensis
  ref <308>: DATABASE ACCESSION NUMBER: NCBI ACCESSION: NZ_JMIH01000044.1
  ref <309>: DATABASE ENTRY DATE: 2019-04-01
  ref <313>: RELEVANT RESIDUES IN SEQ ID NO: (1)..(1527)
actatggagagtttgatcctggctcaggatgaacgctagcggcaggcctaatacatgcaagtcgtacgggattcggtctttcgggactgatgagagtggcgcacgggtgcgtaacgcgtatgcaacctgccttctacagggggatagcccggggaaacccggattaataccccatggcaccattagcctgcatgggcatatggttaaagctttcgggcggtagaagatgggcatgcgtaggattagctagttggcggggtaacggcccaccaaggcgacgatccttaggggttctgagaggaaggtcccccacactggcactgagatacgggccagactcctacgggaggcagcagtagggaatattgggcaatggtcggaagactgacccagccatgccgcgtgcaggaagacggcgttatgcgttgtaaactgcttttatacgggaagaaaaagccactgcggtggaaattgccggtaccgtatgaataagcaccggctaactccgtgccagcagccgcggtaatacggagggtgcaagcgttgtccggatttattgggtttaaagggtgcgtaggcggccgattaagtcagcggtgaaagttttcggctcaaccggaaaactgccattgatactggttggcttgagtgttgatggggtacctggaatttatggtgtagcggtgaaatgcatagataccataaggaacaccgatagcgaaggcaaggtacttatcaacaactgacgctgaggcacgaaagcgtgggtagcgaacaggattagataccctggtagtccacgccgtaaacgatgattactcgctgttatgccctctgcggtgtagtggccaagcgaaagcgttaagtaatccacctggggagtacgcccgcaagggtgaaactcaaaggaattgacgggggtccgcacaagcggtggagcatgtggtttaattcgatgatacgcgaggaaccttacctgggctagaatgcgcgtgacggatccggagacggatcttcccttcggggcacaaagcaaggtgctgcatggctgtcgtcagctcgtgccgtgaggtgttgggttaagtcccgcaacgagcgcaacccctatgttcagttgccagcaagtaatgttggggactctggacagactgcctgcgcaagcagagaggaaggaggggacgacgtcaagtcatcatggcccttacgcccagggcgacacacgtgctacaatggcgcatacagcgggtcgctacacagcaatgtgatgccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaagccggtaaccgcaaggagccgtttagggtagaaccggtaactggggctaagtcgtaacaaggtagccgtaccggaaggtgcggctggaacacctcctttct

SEQ ID NO: 1416 - DNA, 1535 bp, Andreesenia angusta
  ref <308>: DATABASE ACCESSION NUMBER: NCBI ACCESSION: NZ_MKIE01000032.1
  ref <309>: DATABASE ENTRY DATE: 2019-04-01
  ref <313>: RELEVANT RESIDUES IN SEQ ID NO: (1)..(1535)
tttttaaatgagagtttgatcctggctcaggatgaacgctggcggcgtgcttaacacatgcaagtcgagcgagagaactcgaaggaaaacttcggtcggaattcgaatgatctagcggcggacgggtgagtaacgcgtgggaaacctgccttgtacaaggggatagcctcgggaaaccgggattaataccctatgaaaccacaagaacacatgttctaatggtcaaagctccggcggtacaagatggtcccgcgtctgattagctagttggagaggtaacggctcaccaaggcgacgatcagtagccggcctgagagggtgaacggccacactggaactgagacacggtccagactcctacgggaggcagcagtggggaatattgcacaatgggggaaaccctgatgcagcgacgccgcgtgagcgaagaaggctttcgggtcgtaaagctctgtcctaagggaagatagtgacggtaccttaggaggaagccccggctaactacgtgccagcagccgcggtaatacgtagggggcgagcgttatccggaattattgggcgtaaagggttcgcaggtggtcctttaagtcaggtgtgaaaggcagtggctcaaccattgcaagcacttgaaactgaaggacttgagtacaggagaggaaagcggaattcctagtgtagcggtgaaatgcgtagatattaggaggaacaccagtggcgaaggcggctttctggactgaaactgacactgaggaacgaaagcgtggggagcaaacaggattagataccctggtagtccacgccgtaaacgatgagtgctaggtgttgggggtcgaacctcagtgccgcagctaacgcattaagcactccgcctggggagtacggtcgcaagactgaaactcaaaggaattgacggggacccgcacaagtagcggagcatgtggtttaattcgaagcaacgcgaagaaccttaccaaggcttgacatccctctgaccgcactagagatagtgcttctcttcggagcagaggtgacaggtggtgcatggttgtcgtcagctcgtgtcgtgagatgttgggttaagtcccgcaacgagcgcaacccctgcatttagttgctacattaagttgagcactctagatggactgccggtgacaaaccggaggaaggtggggatgacgtcaaatcatcatgccccttatgccttgggctacacacgtgctacaatggtcggtacaacgggcagcgaaggagcgatctggagcgaatcccaagaagccgatctcagttcggattgcaggctgcaactcgcctgcatgaagccggagttactagtaatcgcggatcagaatgccgcggtgaatacgttcccgggtcttgtacacaccgcccgtcacaccacgagagttggtaacacccgaagtcagtgagctaaccttttaggaggcagctgccgaaggtgggattgatgattggggtgaagtcgtaacaaggtagccgtatcggaaggtgcggctggatcacctcctttctaagga

SEQ ID NO: 1417 - DNA, 1538 bp, Aneurinibacillus aneurinilyticus
  ref <308>: DATABASE ACCESSION NUMBER: NCBI ACCESSION: NZ_KE952670.1
  ref <309>: DATABASE ENTRY DATE: 2019-04-01
  ref <313>: RELEVANT RESIDUES IN SEQ ID NO: (1)..(1538)
ttggagagtttgatcctggctcaggacgaacgctggcggcgtgcctaatacatgcaagtcgagcggaccaaagaagagcttgctcttcggcggttagcggcggacgggtgagtaacacgtaggcaacctgcctgtacgactgggataactccgggaaaccggagctaataccggatacgtttttcagaccgcatggtctgaaagagaaagacctttggtcacgtacagatgggcctgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaaccgccgggatgacctcccggtctgacggtacctaacgagaaagccccggctaactacgtgccagcagccgcggtaatacgtagggggcaagcgttgtccggaattattgggcgtaaagcgcgcgcaggcggcttcttaagtcaggtgtgaaagcccacggctcaaccgtggagggccacttgaaactgggaggcttgagtgcaggagaggagagcggaattccacgtgtagcggtgaaatgcgtagagatgtggaggaacacccgtggcgaaggcggctctctggcctgtaactgacgctgaggcgcgaaagcgtggggagcgaacaggattagataccctggtagtccacgccgtaaacgttgagtgctaggtgttggggactccaatcctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccagggcttgacatcccgctgtccctcctagagataggagctctcttcggagcagcggtgacaggtggtgcatggttgtcgtcagctcgtgtcgtgagatgttgggttaagtcccgcaacgagcgcaacccttgtccttagttgccagcattcagttgggcactctagggagactgccgtcgacaagacggaggaaggtggggatgacgtcaaatcatcatgccccttatgtcctgggctacacacgtgctacaatggatggaacaacgggcagccaactcgcgagagtgcgccaatcccttaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaaccgcaaggagccagccgccgaaggtggggcagatgattggggtgaagtcgtaacaaggtatccgtaccggaaggtgcggatggatcacctcctttct

SEQ ID NO: 1418 - DNA, 1545 bp, Aneurinibacillus sp. XH2
  ref <308>: DATABASE ACCESSION NUMBER: NCBI ACCESSION: NZ_CP014140.1
  ref <309>: DATABASE ENTRY DATE: 2019-04-01
  ref <313>: RELEVANT RESIDUES IN SEQ ID NO: (1)..(1545)
ttttttggagagtttgatcctggctcaggacgaacgctggcggcgtgcctaatacatgcaagtcgagcgaaccgatggagtgcttgcattcctgaggttagcggcggacgggtgagtaacacgtaggcaacctgcctgtacgaccgggataactccgggaaaccggagctaataccggataggatgccgaaccgcatggttcggcatggaaaggcctttgagccgcgtacagatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaggaaggtcttcggatcgtaaaactctgttgtcagggaagaaccgccgggatgacctcccggtctgacggtacctgacgagaaagccccggctaactacgtgccagcagccgcggtaatacgtagggggcaagcgttgtccggaattattgggcgtaaagcgcgcgcaggcggcttcttaagtcaggtgtgaaagcccacggctcaaccgtggagggccatctgaaactggggagcttgagtgcaggagaggagagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaggtgttggggagtccacctcctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccagggcttgacatcccgctgacccctccagagatggaggtttccttcgggacagcggtgacaggtggtgcatggttgtcgtcagctcgtgtcgtgagatgttgggttaagtcccgcaacgagcgcaacccttgtcctttgttgccagcattcagttgggcactctaaggagactgccgtcgacaagacggaggaaggtggggatgacgtcaaatcatcatgccccttatgtcctgggctacacacgtgctacaatggacggtacaacgggcgtgccaacccgcgagggtgagccaatccctaaaaaccgttctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaaccttctggagccagccgccgaaggtggggcagatgattggggtgaagtcgtaacaaggtatccgtaccggaaggtgcggatggatcacctcctttcta

SEQ ID NO: 1419 - DNA, 292 bp, Aneurinibacillus terranovensis
  ref <308>: DATABASE ACCESSION NUMBER: NCBI ACCESSION: NZ_AUMJ01000067.1
  ref <309>: DATABASE ENTRY DATE: 2019-04-01
  ref <313>: RELEVANT RESIDUES IN SEQ ID NO: (1)..(292)
ttttttggagagtttgatcctggctcaggacgaacgctggcggcgtgcctaatacatgcaagtcgagcggacctttaaaagcttgcttttaaaggttagcggcggacgggtgagtaacacgtgggcaacctgcctgtaagctcgggataactccgggaaaccggagctaataccgaatacgattcgcaaccgcatggttgcgaatggaaagttttcgaacacttacagatgggcccgcggcgcattagctggttggtggggtaacggcctaccaaggcgacgatgcgtagcc

SEQ ID NO: 1420 - DNA, 1514 bp, Angelakisella massiliensis
  ref <308>: DATABASE ACCESSION NUMBER: NCBI ACCESSION: NZ_LT629945.1
  ref <309>: DATABASE ENTRY DATE: 2019-04-01
  ref <313>: RELEVANT RESIDUES IN SEQ ID NO: (1)..(1514)
tttaatgaagagtttgatcctggctcaggacgaacgctggcggcgcgcctaacacatgcaagtcgaacggagtaagatgagcttgcttatcttacttagtggcggacgggtgagtaacacgtgagcaacctgccttcgagtggggaataacagtcggaaacgactgctaataccgcataacacattgggatggcatcatcctgatgtcaaagatttatcgctcgaagatgggctcgcgtccgattagctagttggcggggtaacggcccaccaaggcgacgatcggtagccggactgagaggttgatcggccacattgggactgagacacggcccagactcctacgggaggcagcagtgggggatattgcacaatgggggaaaccctgatgcagcgacgccgcgtgtaggaagacggtcctctggattgtaaactactgtcttcagggacgataatgacggtacctgaggaggaagctccggctaactacgtgccagcagccgcggtaatacgtagggagcgagcgttgtccggaattactgggtgtaaagggagcgtaggcggggaggcaagttggatgtgaaaactatcggctcaactgatagactgcattcaaaactgtttctcttgagtgaagtagaggcaggcgggattcctagtgtagcggtgaaatgcgtagatattaggaggaacaccagtggcgaaggcggcctgctgggcttttactgacgctgaggctcgaaagtgtggggagcaaacaggattagataccctggtagtccacaccgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatctcctgcataacctagagataggtgaagtccttcgggacaggaagacaggtggtgcatggttgtcgtcagctcgtgtcgtgagatgttgggttaagtcccgcaacgagcgcaacccttgtttttagttgctacgcaagagcactctaaagagactgccgttgacaaaacggaggaaggtggggatgacgtcaaatcatcatgccccttatgacctgggctacacacgtactacaatggcaattaacagagggaagcgacaccgcgaggtggagcaaaaccctaaaaattgtcccagttcagattgcaggctgcaactcgcctgcatgaagtcggaattgctagtaatcgcggatcagcatgccgcggtgaatacgttcccgggccttgtacacaccgcccgtcacaccatgggagtcggtaacacccgaagtcagtagcctaaccgcaaggagggcgctgccgaaggtgggattgatgactggggtgaagtcgtaacaaggtagccgtatcggaaggtgcggctggatcacctcctttcta

SEQ ID NO: 1421 - DNA, 1559 bp, Anoxybacillus amylolyticus
  ref <308>: DATABASE ACCESSION NUMBER: NCBI ACCESSION: NZ_CP015438.1
  ref <309>: DATABASE ENTRY DATE: 2019-04-01
  ref <313>: RELEVANT RESIDUES IN SEQ ID NO: (1)..(1559)
ttctatggagagtttgatcctggctcaggacgaacgctggcggcgtgcctaatacatgcaagtcgagcggaccgaataggagcttgcttctgttcggttagcggcggacgggtgagtaacacgtgggcaacctgcccgtaagaccgggataacttcgggaaaccggagctaataccggataacaccgaagaccgcatggtctttggttgaaaggcggcgcaagctgtcacttacggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggattgtaaagctctgttgttagggaagaacaagtaccgcagtaactggcggtaccttgacggtacctaacgagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactgagggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttacaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccttgacaacccaagagattgggggttccccttcgggggacaaggtgacaggtggtgcatggttgtcgtcagctcgtgtcgtgagatgttgggttaagtcccgcaacgagcgcaacccttgaccttagttgccagcattcagttgggcactctaaggtgactgccgatgacaaatcggaggaaggtggggatgacgtcaaatcatcatgccccttatgacctgggctacacacgtgctacaatgggcggtacaaagggttgcaaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttttgggagccagccgccgaaggtggggcagatgattggggtgaagtcgtaacaaggtagccgtatcggaaggtgcggctggatcacctcctttctaa

SEQ ID NO: 1422 - DNA, 1074 bp, Anoxybacillus ayderensis
  ref <308>: DATABASE ACCESSION NUMBER: NCBI ACCESSION: NZ_NDEZ01000080.1
  ref <309>: DATABASE ENTRY DATE: 2019-04-01
  ref <313>: RELEVANT RESIDUES IN SEQ ID NO: (1)..(1074)
ttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaaatgattggggtgaagtcgtaacaaggtagccgtatcggaaggtgcggctggatcacctcctttctaa

SEQ ID NO: 1423 - DNA, 1562 bp, Anoxybacillus gonensis
  ref <308>: DATABASE ACCESSION NUMBER: NCBI ACCESSION: NZ_CP012152.1
  ref <309>: DATABASE ENTRY DATE: 2019-04-01
  ref <313>: RELEVANT RESIDUES IN SEQ ID NO: (1)..(1562)
ttctatggagagtttgatcctggctcaggacgaacgctggcggcgtgcctaatacatgcaagtcgagcggacgattcaaaagcttgcttttggatcgttagcggcggacgggtgagtaacacgtgggcaacctgccctgtagacggggataacaccgagaaatcggtgctaataccggataatacgaaaggccgcatggtctttcgttgaaaggcggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaccgcagtcactggcggtaccttgacggtacctaacgaggaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatcgaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgaggggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttccgggagccagccgccgaaggtggggtaaatgattggggtgaagtcgtaacaaggtagccgtatcggaaggtgcggctggatcacctcctttctaa

SEQ ID NO: 1424 - DNA, 1374 bp, Anoxybacillus mongoliensis
  ref <308>: DATABASE ACCESSION NUMBER: NCBI ACCESSION: NZ_MRZM01000072.1
  ref <309>: DATABASE ENTRY DATE: 2019-04-01
  ref <313>: RELEVANT RESIDUES IN SEQ ID NO: (1)..(1374)
aagaccgcatggtttttcgttgaaaggcggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaccgcagtcactggcggtaccttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaaatgattggggtgaagtcgtaacaaggtagccgtatcggaaggtgcggctggatcacctcctttctaa

SEQ ID NO: 1425 - DNA, 1560 bp, Anoxybacillus sp. 103
  ref <308>: DATABASE ACCESSION NUMBER: NCBI ACCESSION: NZ_MQAD01000040.1
  ref <309>: DATABASE ENTRY DATE: 2019-04-01
  ref <313>: RELEVANT RESIDUES IN SEQ ID NO: (1)..(1560)
ttctatggagagtttgatcctggctcaggacgaacgctggcggcgtgcctaatacatgcaagtcgagcggacgaatcgaaagcttgcttttgattcgttagcggcggacgggtgagtaacacgtgggcaacctgccctgtagacggggataacaccgagaaatcggtgctaataccggataacacgaaatgtcgcatgacgtttcgttgaaagacggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaacgcagtaactggcgttaccgtgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaaatgattggggtgaagtcgtaacaaggtagccgtatcggaaggtgcggctggatcacctcctttcta

SEQ ID NO: 1426 - DNA, 1560 bp, Anoxybacillus sp. B2M1
  ref <308>: DATABASE ACCESSION NUMBER: NCBI ACCESSION: NZ_CP015435.1
  ref <309>: DATABASE ENTRY DATE: 2019-04-01
  ref <313>: RELEVANT RESIDUES IN SEQ ID NO: (1)..(1560)
tcttttggagagtttgatcctggctcaggacgaacgctggcggcgtgcctaatacatgcaagtcgagcggaccgaatagaagcttgcttctgttcggttagcggcggacgggtgagtaacacgtgggcaacctgcccgtaagacggggataacttcgggaaaccggagctaatacccgataaccctgaagaccgcatggtctttagttgaaaggcggcttcggctgtcacttacggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggattgtaaagctctgttgttagggaagaacaagtgcggttcgaatagggtcgtaccttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggggagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaccccgagagatcgggcgttccccttcgggggacagggtgacaggtggtgcatggttgtcgtcagctcgtgtcgtgagatgttgggttaagtcccgcaacgagcgcaacccttgaccttagttgccagcattgagttgggcactctaaggtgactgccgatgacaaatcggaggaaggtggggatgacgtcaaatcatcatgccccttatgacctgggctacacacgtgctacaatgggcggtacaaagggttgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaa

SEQ ID NO: 1427 - DNA, 1560 bp, Anoxybacillus sp. B7M1
  ref <308>: DATABASE ACCESSION NUMBER: NCBI ACCESSION: NZ_CP015436.1
  ref <309>: DATABASE ENTRY DATE: 2019-04-01
  ref <313>: RELEVANT RESIDUES IN SEQ ID NO: (1)..(1560)
tcttttggagagtttgatcctggctcaggacgaacgctggcggcgtgcctaatacatgcaagtcgagcggaccgaatagaagcttgcttctgtttggttagcggcggacgggtgagtaacacgtgggcaacctgcccgtaagacggggataacttcgggaaaccggagctaatacccgataaccctgaagaccgcatggtctttagttgaaaggcggcttcggctgtcacttacggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggattgtaaagctctgttgttagggaagaacaagtgcggttcgaatagggccgtaccttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaccccgagagatcgggcgttccccttcgggggacagggtgacaggtggtgcatggttgtcgtcagctcgtgtcgtgagatgttgggttaagtcccgcaacgagcgcaacccttgaccttagttgccagcattgagttgggcactctaaggtgactgccgatgacaaatcggaggaaggtggggatgacgtcaaatcatcatgccccttatgacctgggctacacacgtgctacaatgggcggtacaaagggttgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaa

SEQ ID NO: 1428 - DNA, 1555 bp, Anoxybacillus sp. BCO1
  ref <308>: DATABASE ACCESSION NUMBER: NCBI ACCESSION: NZ_JRLC01000086.1
  ref <309>: DATABASE ENTRY DATE: 2019-04-01
  ref <313>: RELEVANT RESIDUES IN SEQ ID NO: (1)..(1555)
ctatggagagtttgatcctggctcaggacgaacgctggcggcgtgcctaatacatgcaagtcgagcggacgattcaaaagcttgcttttgaatcgttagcggcggacgggtgagtaacacgtgggcaacctgcctgtagacggggataacaccgagaaatcggtgctaataccggataacacgaagaccgcatggtttttcgttgaaaggcggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaccgcagtcactggcggtaccttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccactttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaaatgattggggtgaagtcgtaacaaggtagccgtatcggaaggtgcggctggatcacctcctttctaa

SEQ ID NO: 1429 - DNA, 1560 bp, Anoxybacillus sp. KU2-6 11
  ref <308>: DATABASE ACCESSION NUMBER: NCBI ACCESSION: NZ_JPZN01000047.1
  ref <309>: DATABASE ENTRY DATE: 2019-04-01
  ref <313>: RELEVANT RESIDUES IN SEQ ID NO: (1)..(1560)
ttctatggagagtttgatcctggctcaggacgaacgctggcggcgtgcctaatacatgcaagtcgagcggacgaatcaaaagcttgcttttgattcgttagcggcggacgggtgagtaacacgtgggcaacctgccctgtagacggggataacaccgagaaatcggtgctaataccggataacacgaaatgtcgcatgacgtttcgttgaaagacggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaccgcagtcactggcggtaccttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggttgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaaatgattggggtgaagtcgtaacaaggtagccgtatcggaaggtgcggctggatcacctcctttcta

SEQ ID NO: 1430 - DNA, 1465 bp, Anoxybacillus sp. P3H1B
  ref <308>: DATABASE ACCESSION NUMBER: NCBI ACCESSION: NZ_LPUG01000026.1
  ref <309>: DATABASE ENTRY DATE: 2019-04-01
  ref <313>: RELEVANT RESIDUES IN SEQ ID NO: (1)..(1465)
ggttagcggcggacgggtgagtaacacgtgggcaacctgcccgtaagacggggataacttcgggaaaccggagctaatacccgataaccctgaagaccgcatggtctttagttgaaaggcggcttcggctgtcacttacggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggattgtaaagctctgttgttagggaagaacaagtgcggttcgaatagggccgtaccttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaccccgagagatcgggcgttccccttcgggggacagggtgacaggtggtgcatggttgtcgtcagctcgtgtcgtgagatgttgggttaagtcccgcaacgagcgcaacccttgaccttagttgccagcattgagttgggcactctaaggtgactgccgatgacaaatcggaggaaggtggggatgacgtcaaatcatcatgccccttatgacctgggctacacacgtgctacaatgggcggtacaaagggttgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttatgggagccagccgccgaaggtggggcagatgattggggtgaagtcgtaacaaggtagccgtatcggaaggtgcggctggatcacctcctttctaa

SEQ ID NO: 1431 - DNA, 1560 bp, Anoxybacillus sp. UARK-01; identical to SEQ ID NO: 1427
  ref <308>: DATABASE ACCESSION NUMBER: NCBI ACCESSION: NZ_NASY01000002.1
  ref <309>: DATABASE ENTRY DATE: 2019-04-01
  ref <313>: RELEVANT RESIDUES IN SEQ ID NO: (1)..(1560)

SEQ ID NO: 1432 - DNA, 830 bp, Anoxybacillus suryakundensis
  ref <308>: DATABASE ACCESSION NUMBER: NCBI ACCESSION: NZ_CYGZ01000024.1
  ref <309>: DATABASE ENTRY DATE: 2019-04-01
  ref <313>: RELEVANT RESIDUES IN SEQ ID NO: (1)..(830)
ttctatggagagtttgatcctggctcaggacgaacgctggcggcgtgcctaatacatgcaagtcgagcggacgattcaaaagcttgcttttgaatcgttagcggcggacgggtgagtaacacgtgggtaacctgccctatagactgggataactcgcggaaacgtgagctaataccggataatacatcaaagcgcatgttttgatgttgaaagatggttctgctatcactataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtagcgcagtaactggcgttactttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatga

SEQ ID NO: 1433 - DNA, 1098 bp, Anoxybacillus tepidamans
  ref <308>: DATABASE ACCESSION NUMBER: NCBI ACCESSION: NZ_JHVN01000046.1
  ref <309>: DATABASE ENTRY DATE: 2019-04-01
  ref <313>: RELEVANT RESIDUES IN SEQ ID NO: (1)..(1098)
aagtaccgttcgaatagggcggtaccgtgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccctgacaacccgagagatcgggcgttccccttcgggggacagggtgacaggtggtgcatggttgtcgtcagctcgtgtcgtgagatgttgggttaagtcccgcaacgagcgcaacccttgaccttagttgccagcattgagttgggcactctaaggtgactgccgatgacaaatcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcagatgattggggtgaagtcgtaacaaggtagccgtatcggaaggtgcggctggatcacctcctttctaa

SEQ ID NO: 1434 - DNA, 846 bp, Anoxybacillus thermarum
  ref <308>: DATABASE ACCESSION NUMBER: NCBI ACCESSION: NZ_JXTH01000125.1
  ref <309>: DATABASE ENTRY DATE: 2019-04-01
  ref <313>: RELEVANT RESIDUES IN SEQ ID NO: (1)..(846)
agctctgttgttagggaagaacaagtaccgcagtcactggcggtaccttgacggtacctaacgagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtatccaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcaaatgattggggtgaagtcgtaacaaggtagccgtatcggaaggtgcggctggatcacctcctttcta

SEQ ID NO: 1435 - DNA, 1582 bp, Anoxybacter fermentans
  ref <308>: DATABASE ACCESSION NUMBER: NCBI ACCESSION: NZ_CP016379.1
  ref <309>: DATABASE ENTRY DATE: 2019-04-01
  ref <313>: RELEVANT RESIDUES IN SEQ ID NO: (1)..(1582)
tgtttggagagtttgatcctggctcaggacgaacgctggcggcgtgcctaacacatgcaagtcgaacggcctgctctgacggaggccttcgggctgaagttggaagtcaggcagtggcggacgggtgagtaacgcgtgggtaatctacctccgaaacggggataacccaccgaaaggtgggctaataccggatgagcttccgggggcgcatgttcctggaaggaaaggtggcgttaagctgccgatcggagatgagcccgcgtcccattagctagttggtgaggtaacggctcaccaaggcgacgatgggtagccggcctgagagggtgtacggccacactgggactgagacacggcccagactcctacgggaggcagcagtggggaatattccgcaatgggggaaaccctgacggagcaacgccgcgtgggtgaagaagttcttcggaacgtaaagccctgtcatgagggaagaaaggccgcatgtttaagagatgtgcggtttgacggtacctcataagaaagctccggctaactacgtgccagcagccgcggtaatacgtagggagcgagcgttgtccggaattactgggcgtaaagggcgcgtaggcggtctggtaagtcaaatgtgaaatacactggcttaaccagtgggctgcgtttgaaactgccggactagaggtcaggagaggagagtggaattcctggtgtagcggtgaaatgcgtagatatcaggaagaacaccggtggcgaaggcggctctctggcctgtacctgacgctgaggcgcgaaagcgtggggagcgaacgggattagataccccggtagtccacgccgtaaacgatggatactaagtgttgggggtttagataccctcagtgctgtagctaacgcgataagtatcccgcctggggagtacggtcgcaagactgaaactcaaaggaattgacgggggcccgcacaagcggtggagcatgtggtttaattcgaagcaacgcgaagaaccttaccagggcttgacatcccgtgactacctgtgaaagcagggtttggctctttgagccacacggtgacaggtggtgcatggttgtcgtcagctcgtgtcgtgagatgttgggttaagtcccgcaacgagcgcaacccctgtccttagttgccagcgggtaaagccggggactctaaggagactgccggtgacaaaccggaggaaggtggggatgacgtcaaatcatcatgccctttatgccctgggctacacacgtgctacaatgggctgtacaaagggttgcgaagccgcgaggtggagctaatcccaaaaagcagctctcagttcggattgcaggctgcaactcgcctgcatgaagccggaatcgctagtaatcgcaggtcagcatactgcggtgaatacgttcccgggccttgtacacaccgcccgtcacaccacccgagttggatgcaccagaagtcgctgtcctaaccgatgaggggggaggcgccaaaggtgtgtctggtgaggggggtgaagtcgtaacaaggtagccgtaccggaaggtgcggctggatcacctcctttctaaggaga

SEQ ID NO: 1436 - DNA, 1489 bp, Aphanothece sacrum
  ref <308>: DATABASE ACCESSION NUMBER: NCBI ACCESSION: NZ_BDQL01000008.1
  ref <309>: DATABASE ENTRY DATE: 2019-04-01
  ref <313>: RELEVANT RESIDUES IN SEQ ID NO: (1)..(1489)
tatggagagtttgatcctggctcaggatgaacgctggcggtatgcctaacacatgcaagtcgaacggtcacttaggtgatagtggcggacgggtgagtaacgcgtgagaatctgccctcaggatggggacaacagttggaaacgactgctaatacccgatgtgccgcaaggtgaaagatttatcgcctgaggaggagctcgcgtctgattagctagttggtaaggtaaaggcttaccaaggcatcgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcttttctctgggaagaaaaaaatgacggtaccagaggaataagcatcggctaactccgtgccagcagccgcggtaatacggaggatgcaagcgttatccggaatcattgggcgtaaagcgtccgtaggtggtttttcaagtctgctgtcaaagcctggggcttaaccccagataggcagtggaaactgggagactagagttcggtaggggtagcgggaattcccagtgtagcggtgaaatgcgtagatattgggaagaacatcggtggcgaaggcgcgctactgggccgaaactgacactcacaggacgaaagctaggggagcgaaagggattagatacccctgtagtcctagctgtaaacgatggaaactaggtgtggcttgtatcgacccgagccgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatctcttagaaataggagagtgccttcgggaacgcgaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtgaggatgacgtcaagtcagcatgccccttacgccctgggctacacacgtactacaatggttgggacaacgggtagcgaccccgcgagggcaagcgaatctcatcaaacccagcctcagttcagattgcaggctgcaactcgcctgcatgaaggaggaatcgctagtaatcgcaggtcagcatactgcggtgaattcgttcccgggccttgtacacaccgcccgtcacaccatggaagctggccacacccgaagtcgttaccctaacccttgtggagggggacgccgaaggtggggctagtgactggggtgaagtcgtaacaaggtagccgtaccggaaggtgtggctggatcacctcctttt

SEQ ID NO: 1437 - DNA, 1527 bp, Apibacter sp. HY039
  ref <308>: DATABASE ACCESSION NUMBER: NCBI ACCESSION: NZ_SAYM01000012.1
  ref <309>: DATABASE ENTRY DATE: 2019-04-01
  ref <313>: RELEVANT RESIDUES IN SEQ ID NO: (1)..(1527)
tacaatggagagtttgatcctggctcaggatgaacgctagcgggaggcctaacacatgcaagccgaggggtattaaggagcttgcttcttgagagaccggcgcacgggtgcgtaacgcgtatgtaacttgcctctatcactgggatagcccggggaaacccggattaataccggatatactaagtagtaaccttactatttattcaaagatttatcggatagagataggcatgcgtaggattagttagttggtaaggtaacggcttaccaagacgatgatccttagggggcctgagagggtgatcccccacactggaactgagacacggaccagactcctacgggaggcagcagtgaggaatattggacaatgggtgagagcctgatccagccatcccgcgtgaaggacgacagccctatgggttttaaacttcttttgtatggggataaacctatctacgtgtagatagctgaaggtaccatacgaataagcatcggctaactccgtgccagcagccgcggtaatacggaggatgcaagcgttatccggatttattgggtttaaagggtccgtaggcggatttgtaagtcagcggtgaaatcctacagcttaactgtagaactgccgttgatactgcaagtcttgaatagtattgaagtagccggaatgtgtagtgtagcggtgaaatgcatagatattacacagaacaccaattgcgaaggcaggttactaaataccgattgacgctgatggacgaaagcgtggggagcgaacaggattagataccctggtagtccacgccgtaaacgatggatactcgctgttgggctttagggctcagcggctaagcgaaagtaataagtatcccacctggggagtacgaccgcaaggttgaaactcaaaggaattgacgggggcccgcacaagcggtggagcatgtggtttaattcgatgatacgcgaggaaccttaccagggcttaaatgggaattgacgtacctagaaataggtatttcttcggacaattttcaaggtgctgcatggttgtcgtcagctcgtgccgtgaggtgtcaggttaagtcctataacgagcgcaacccctgccattagttgccagcgattcaagtcgggaactctaatgggactgccggtgcaaaccgcgaggaaggtggggatgacgtcaaatcatcacggcccttacgccctgggccacacacgtgctacaatggccggtacagagggcagctacacagcgatgtgatgcgaatctctaaagccggtctcagttcggattggagtctgcaactcgactctatgaagctggaatcgctagtaatcgcatatcagccatgatgcggtgaatacgttcccgggccttgtacacaccgcccgtcaagccatggaagctgggggtgcctgaagtcggtgaccgtaaaaggagctgcctagggtaaaactagtgactggggctaagtcgtaacaaggtagccgtaccggaaggtgcggctggaacatctcttttttaga

SEQ ID NO: 1438 - DNA, 1487 bp, Aquabacter sp. Sn-9-2
  ref <308>: DATABASE ACCESSION NUMBER: NCBI ACCESSION: NZ_RWKV01000013.1
  ref <309>: DATABASE ENTRY DATE: 2019-04-01
  ref <313>: RELEVANT RESIDUES IN SEQ ID NO: (1)..(1487)
tcaacttgagagtttgatcctggctcagagcgaacgctggcggcaggcctaacacatgcaagtcgagcgcccagcaatgggagcggcagacgggtgagtaacgcgtggggatctgcccgatggtacggaataattccgggaaactgggactaataccgtatgtgcccgcaaggggaaagatttatcgccatcggatgaacccgcgtcggattagctagttggtgtggtaaaggcgcaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggtgaagataatgacggtaaccggagaagaagccccggctaacttcgtgccagcagccgcggtaatacgaagggggctagcgttgctcggaatcactgggcgtaaagcgcacgtaggcgggtcgttaagtcagaggtgaaagcctggagctcaactccagaactgcctttgatactggcgacctagagttcgagagaggttggtggaactccgagtgtagaggtgaaattcgtagatattcggaagaacaccagtggcgaaggcggccaactggctcgatactgacgctgaggtgcgaaagcgtggggagcaaacaggattagataccctggtagtccacgccgtaaacgatggatgctagccgttggggagcttgctcttcagtggcgcagctaacgccttaagcatcccgcctggggagtacggtcgcaagattaaaactcaaaggaattgacgggggcccgcacaagcggtggagcatgtggtttaattcgaagcaacgcgcagaaccttaccagcctttgacatggcaggacgatttccagagatggatctcttccagcaatggacctgcacacaggtgctgcatggctgtcgtcagctcgtgtcgtgagatgttgggttaagtcccgcaacgagcgcaaccctcgcctttagttgccatcattcagttgggcactctaaagggactgccggtgataagccgcgaggaaggtggggatgacgtcaagtcctcatggcccttacgggctgggctacacacgtgctacaatggtggtgacagtgggatgcgaaagggcgacctctagcaaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggcgctgcgctaaccgcaaggaggcaggcgaccacggtagggtcagcgactggggtgaagtcgtaacaaggtagccgtaggggaacctgcggctggatcacctcctttcta

SEQ ID NO: 1439 - DNA, 1540 bp, Aquabacterium sp. SJQ9
  ref <308>: DATABASE ACCESSION NUMBER: NCBI ACCESSION: NZ_RSED01000005.1
  ref <309>: DATABASE ENTRY DATE: 2019-04-01
  ref <313>: RELEVANT RESIDUES IN SEQ ID NO: (1)..(1540)
agattaaactgaagagtttgatcctggctcagattgaacgctggcggcatgccttacacatgcaagtcgaacggcagcacgggagcaatcctggtggcgagtggcgaacgggtgagtaatatatcggaacgtgcccagtaatgggggatagcccggcgaaagccggattaataccgcatacgacctacgggtgaaagcgggggatcgcaagacctcgcgttattggagcggccgatatcagattaggtagttggtggggtaaaggcctaccaagcctgcgatctgtagttggtctgagaggacgaccagccacactgggactgagacacggcccagactcctacgggaggcagcagtggggaattttggacaatgggcgcaagcctgatccagcaatgccgcgtgcaggaagaaggccttcgggttgtaaactgcttttgtcagggaagaaatcctctgggttaatacctcggggggatgacggtacctgaagaataagcaccggctaactacgtgccagcagccgcggtaatacgtagggtgcgagcgttaatcggaattactgggcgtaaagcgtgcgcaggcggttgtgcaagacaggtgtgaaatccccgggcttaacctgggaactgcacttgtgactgcacggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttggacggcttgctgttcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgttaagaatcttgcagagatgtgagagtgctcgaaagagaacttaaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcctcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctag

SEQ ID NO: 1440 - DNA, 1537 bp, Aquabacterium sp. YIM 730274
  ref <308>: DATABASE ACCESSION NUMBER: NCBI ACCESSION: NZ_QXMG01000125.1
  ref <309>: DATABASE ENTRY DATE: 2019-04-01
  ref <313>: RELEVANT RESIDUES IN SEQ ID NO: (1)..(1537)
agatcgaactatagagtttgatcctggctcagattgaacgctggcggcatgccttacacatgcaagtcgaacggtaacgcggggcaacctggcgacgagtggcgaacgggtgagtaatgcatcggaacgtgcccagtagtgggggatagcccggcgaaagccggattaataccgcatgagacctgagggtgaaagcgggggaccgaaaggcctcgcgctattggagcggccgatgtcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagccatgccgcgtgcaggaagaaggccttcgggttgtaaactgcttttgttcgggaagaaatcccttgggctaatacctcggggggatgacggtaccggaagaataagcaccggctaactacgtgccagcagccgcggtaatacgtagggtgcgagcgttaatcggaattactgggcgtaaagcgtgcgcaggcggttgtgcaagacagatgtgaaatccccgggctcaacctgggaactgcatttgtgactgcacggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggacggcttgctgttcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgtcaggaatcccgaagagatttgggagtgctcgaaagagaacctgaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccggtacagagggctgccaacccgcgagggggagccaatcccagaaaaccggtcgtagtccggatcgcagtctgcaactcgactgcgtgaagtcggaatcgctagtaatcgcggatcagcatgtcgcggtgaatacgttcccgggtcttgtacacaccgcccgtcacaccatgggagcgggttctgccagaagtgggtagcctaaccgaaaggggggcgcttaccacggcagggttcgtgactggggtgaagtcgtaacaaggtagccgtatcggaaggtgcggctggatcacctcctttctg

SEQ ID NO: 1441 - DNA, 1493 bp, Aquamicrobium defluvii
  ref <308>: DATABASE ACCESSION NUMBER: NCBI ACCESSION: NZ_KK073880.1
  ref <309>: DATABASE ENTRY DATE: 2019-04-01
  ref <313>: RELEVANT RESIDUES IN SEQ ID NO: (1)..(1493)
ttgaacatgagagtttgatcctggctcagaacgaacgctggcggcaggcttaacacatgcaagtcgagcgccccgcaaggggagcggcagacgggtgagtaacgcgtgggaatctacccatcactacggaataacccagggaaacttggactaataccgtatacgaccgagaggtgaaagatttatcggtgatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatcgatcagttaggggtgaaatcccggggctcaaccccggaactgcctctaatactgtcgatctcgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatggaagctagccgtcgggcagtttactgttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccgatcgcggacagtggagacattgtccttcagttaggctggatcggtgacaggtgctgcatggctgtcgtcagctcgtgtcgtgagatgttgggttaagtcccgcaacgagcgcaaccctcgcccttagttgcccttattcagttaggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaaggaggcaggcgaccacggtagggtcagcgactggggtgaagtcgtaacaaggtagccgtaggggaacctgcggctggatcacctcctttctaagg

SEQ ID NO: 1442 - DNA, 1471 bp, Aquidulcibacter paucihalophilus
  ref <308>: DATABASE ACCESSION NUMBER: NCBI ACCESSION: NZ_NCSQ01000081.1
  ref <309>: DATABASE ENTRY DATE: 2019-04-01
  ref <313>: RELEVANT RESIDUES IN SEQ ID NO: (1)..(1471)
caatctgagagtttgatcctggctcagagcgaacgctggcggcaggcttaacacatgcaagtcgaacgccatcttcggatggagtggcagacgggtgagtaacgcgtgggaacgtaccctttggttcggaatattctcgggaaactgagagcaataccggataagccctacgggggaaagatttatcgccaaaggagcggcccgcgtcagattaggtagttggtggggtaaaggcctaccaagcctacgatctgtagctggtctgagaggatgatcagccacactgggactgagacacggcccagactcctacgggaggcagcagtggggaatcttggacaatgggcgcaagcctgatccagccatgccgcgtggatgatgaaggccttagggttgtaaaatcctttcaacggggacgataatgacggtacccgtagaagaagccccggctaacttcgtgccagcagccgcggtaatacgaagggggctagcgttgctcggaattactgggcgtaaagcgcacgtaggcggatatttaagtcggaggtgaaatcccagggctcaaccctggaactgccctcgatactgggtatctggaccaaagtagaggtaagtggaattccgagtgtagaggtgaaattcgtagatattcggaggaacaccagtggcgaaggcgacttactggacttttggtgacgctgaggtgcgaaagcgtggggagcaaacaggattagataccctggtagtccacgccgtaaacgatgaatgctagttgtcagcacgcatgcgtgttggtgacgcagctaacgcattaagcattccgcctggggagtacggccgcaaggttaaaactcaaaggaattgacgggggcccgcacaagcggtggagcatgtggtttaattcgaagcaacgcgcagaaccttacctacgcttgacatgtctcggaacaggaccagagatggacctggacggttcggccgccgagaacacaggtgctgcatggctgtcgtcagctcgtgtcgtgagatgttgggttaagtcccgcaacgagcgcaaccctcgctactagttgccagcacgtctgggtgggcactctagtggaactgccggtggcaagccggaggaaggtggggatgacgtcaagtcctcatggcccttacgcgtagggctacacacgtgctacaatggtggtgacagagggttaatccctaaaagccatctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggctgtgcgccaaccgcaagggggcagcagaccacggtgggatcagcgactggggtgaagtcgtaacaaggtagccgtaggggaacctgcggctggatcacctcctttctaa

SEQ ID NO: 1443 - DNA, 1587 bp, Aquifex aeolicus
  ref <308>: DATABASE ACCESSION NUMBER: NCBI ACCESSION: NC_000918.1
  ref <309>: DATABASE ENTRY DATE: 2019-04-01
  ref <313>: RELEVANT RESIDUES IN SEQ ID NO: (1)..(1587)
tttccctgaagagtttgatcctggctcagcgcgaacgctggcggcgtgcctaacacatgcaagtcgtgcgcagggtcggccccttttggggccggccgctgagcggcaaacgggtgagtaacacgtgggtaacctacccccaggagggggataaccccgggaaaccggggctaataccccataatgccacccgccactaaggcgcggtggccaaagggggcctctggccttcggccacgctcccgcctggggatgggcccgcggcccatcaggtagttggtggggtaacggcccaccaagcctatgacgggtagccggcctgagagggtggccggccacagcgggactgagacacggcccgcacccctacggggggcagcagtggggaatcgtgggcaatgggcgaaagcctgaccccgcgacgccgcgtgggggatgaagccctgcggggtgtaaacccctgtcgggggggacgatgcggacacgggttaatagcccgtgtccgtgacggtacccccagaggaagggacggctaactacgtgccagcagccgcggtaatacgtaggtcccaagcgttgcgcgaagtcactgggcgtaaagcgtccgcagccggtcgggtaagcgggatgtcaaagcccacggctcaaccgtggaccggcatcccgaactgcccgacttgaggcacgcccgggcaggcggaattcccggggtagcggtgaaatgcgtagatctcgggaggaacaccgaaggggaagccagcctgctggggctgtcctgacggtcagggacgaaagccgggggagcaaaccggattagatacccgggtagtcccggccgtaaaccatgggcgctagggcttgtccctctggggcaggctcgcagctaacgcgttaagcgccccgcctggggagtacgggcgcaagcctgaaactcaaaggaattggcgggggcccgcacaaccggtggagcgtctggttcaattcgatgctaaccgaagaaccttacccgggcttgacatgccggggagactccgcgaaagcggagttgtggaagtccctaggactttcccccggcacaggtggtgcatggccgtcgtcagctcgtgtcgtgagatgttgggttaagtcccgcaacgagcgcaacccctgcccccagttgctaccccgtttggggagcactctggggggaccgccggcgataagccggaggaagggggggatgacgtcaggtcagtatgccctttatgcccggggccacacaggcgctacagtggccgggacaatgggatgcgaccccgtaagggggagctaatccctaaacccggtcatggtgcggattgggggctgaaactcgcccccatgaagccggaatcggtagtaacggggtatcagcgatgtccccgtgaatacgttctcgggccttgcacacaccgcccgtcacgccacggaagtcggtccggccggaagtccccgagctaaccggctccttcgggagccggaggcaggggccgatggccgggccggcgactggggcgaagtcgtaacaaggtagccgtaggggaacctgcggctggatcacctccttta

SEQ ID NO: 1444 - DNA, 1527 bp, Aquiflexum balticum
  ref <308>: DATABASE ACCESSION NUMBER: NCBI ACCESSION: NZ_LT838813.1
  ref <309>: DATABASE ENTRY DATE: 2019-04-01
  ref <313>: RELEVANT RESIDUES IN SEQ ID NO: (1)..(1527)
tacaatggagagtttgatcctggctcaggatgaacgctagcggcaggcctaatacatgcaagtcgtacggcaagttgaggagcaatccgagacctagagtggcgcacgggtgcgtaacgcgtatgcaacctgccccttaccgggggatagcccggggaaacccggattaataccccatggcatgatttcatggcatcatgagattattaaagatttatcggtaagggatgggcatgcgtaggattagttagttggcggggtaacggcccaccaagacgatgatccttaggggttctgagaggaaggtcccccacactggcactgagatacgggccagactcctacgggaggcagcagtagggaatattgggcaatggccggaaggctgacccagccatgccgcgtgcaggaagacggcgttatgcgttgtaaactgcttttatacgggaagaaaaaggccatgcgtggcaaattgccggtaccgtatgaataagcaccggctaactccgtgccagcagccgcggtaatacggagggtgcgagcgttgtccggatttattgggtttaaagggtgcgtaggcggcccgataagtcagcggtgaaagtcagtggctcaaccattggagtgccgttgatactgttgggcttgagtgcggtctgggtacatggaatttatggtgtagcggtgaaatgcatagataccataaggaacaccgatagcgtaggcattgtactgggccgtaactgacgctgaggcacgaaagcatgggtagcgaacaggattagataccctggtagtccatgccgtaaacgatgatcactcgctgtcctgcccctgaggtgcggcggccaagcgaaagcgttaagtgatccacctggggagtacgccggcaacggtgaaactcaaaggaattgacgggggtccgcacaagcggtggagcatgtggtttaattcgatgatacgcgaggaaccttacccgggctagaatgtgaaggaatgatttagagatagatcagtcggcaacgacctgaaacaaggtgctgcatggctgtcgtcagctcgtgccgtgaggtgttgggttaagtcccgcaacgagcgcaacccctgtcattagttgccagcacgtcaaggtggggactctaatgggactgcctgcgcaagcagagaggaaggaggggacgacgtcaagtcatcatggcccttacgcccggggcgacacacgtgctacaatggcgcatacagcgggtagctacccggcaacgggatgccaacctctaaaagtgcgtctcagttcggatcggggtctgcaacccgaccccgtgaagctggaatcgctagtaatcgcgcatcagccatggcgcggtgaatacgttcccggaccttgtacacaccgcccgtcaagccatggaagtcgggtagacctgaaggcggtaaccgcaaggagccgttaagggtagaaccggtaactggggctaagtcgtaacaaggtagccgtaccggaaggtgcggctggaacacctcctttct

SEQ ID NO: 1445 - DNA, 1527 bp, Aquimarina aggregata
  ref <308>: DATABASE ACCESSION NUMBER: NCBI ACCESSION: NZ_LQRT01000041.1
  ref <309>: DATABASE ENTRY DATE: 2019-04-01
  ref <313>: RELEVANT RESIDUES IN SEQ ID NO: (1)..(1527)
acgatgaagagtttgatcctggctcaggatgaacgctagcggcaggcttaacacatgcaagtcgaggggtaacataagtgcttgcacttgatgacgaccggcgcacgggtgcgtaacgcgtatagaacctaccttatagtaagggatagcccagagaaatttggattaataccttatagtattattgattggcatcgattaataattaaagatttattgctataagatggctatgcgttctattagctagttggtatggtaacggcataccaaggctacgatagataggggtcctgagagggagatcccccacactggtactgagacacggaccagactcctacgggaggcagcagtgaggaatattggacaatggaggcaactctgatccagccatgccgcgtgtaggaagactgccctatgggttgtaaactacttttatagaggaagaaaccccgatatgtatatcggtctgacggtactctacgaataaggatcggctaactccgtgccagcagccgcggtaatacggaggatccaagcgttatccggaatcattgggtttaaagggtccgtaggcggttttgtaagtcagtggtgaaagttttcggcttaaccggaaaattgccattgatactgcaagacttgaattattgtgaagtggttagaatgtgtagtgtagcggtgaaatgcatagatattacacagaataccgattgcgaaggcagatcactaacaatatattgacgctaagggacgaaagcgtgggtagcgaacaggattagataccctggtagtccacgccgtaaacgatggttactagctgttcggacttcggtctgagtggctaagcgaaagtgataagtaacccacctggggagtacgttcgcaagaatgaaactcaaaggaattgacgggggcccgcacaagcggtggagcatgtggtttaattcgatgatacgcgaggaaccttaccagggcttaaatgtagattgacaggtttagagatagacttttcttcggacaatttacaaggtgctgcatggttgtcgtcagctcgtgccgtgaggtgtcaggttaagtcctataacgagcgcaacccctgttgttagttgccagcgagtaatgtcgggaactctaacaagactgccggtgcaaaccgcgaggaaggtggggatgacgtcaaatcatcacggcccttacgtcctgggccacacacgtgctacaatggtaggtacagagagcagccactgggtgaccaggagcgaatctataaagcctatcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagtccgtcaccgtaaggagcggcctagggtaaaactggtaactggggctaagtcgtaacaaggtagccgtaccggaaggtgcggctggaacacctcctttctaga

SEQ ID NO: 1446 - DNA, 1527 bp, Aquimarina sp. AD10
  ref <308>: DATABASE ACCESSION NUMBER: NCBI ACCESSION: NZ_RAZY01000081.1
  ref <309>: DATABASE ENTRY DATE: 2019-04-01
  ref <313>: RELEVANT RESIDUES IN SEQ ID NO: (1)..(1527)
acgatgaagagtttgatcctggctcaggatgaacgctagcggcaggcttaacacatgcaagtcgaggggtaacataagtgcttgcacttgatgacgaccggcgcacgggtgcgtaacgcgtatagaacctaccttatagtaagggatagcccagagaaatttggattaataccttatagtattattgattggcatcgattaataattaaagatttattgctataagatggctatgcgttctattagctagttggtatggtaacggcataccaaggctacgatagataggggtcctgagagggagatcccccacactggtactgagacacggaccagactcctacgggaggcagcagtgaggaatattggacaatggaggcaactctgatccagccatgccgcgtgtaggaagactgccctatgggttgtaaactacttttatagaggaagaaaccccgatatgtatatcggtctgacggtactctacgaataaggatcggctaactccgtgccagcagccgcggtaatacggaggatccaagcgttatccggaatcattgggtttaaagggtccgtaggcggttttgtaagtcagtggtgaaagttttcggctcaaccggaaaattgccattgatactgcaagacttgaattattgtgaagtggttagaatgtgtagtgtagcggtgaaatgcatagatattacacagaataccgattgcgaaggcagatcactaacaatatattgacgctaagggacgaaagcgtgggtagcgaacaggattagataccctggtagtccacgccgtaaacgatggttactagctgttcggacttcggtctgagtggctaagcgaaagtgataagtaacccacctggggagtacgttcgcaagaatgaaactcaaaggaattgacgggggcccgcacaagcggtggagcatgtggtttaattcgatgatacgcgaggaaccttaccagggcttaaatgtagattgacaggtttagagatagacttttcttcggacaatttacaaggtgctgcatggttgtcgtcagctcgtgccgtgaggtgtcaggttaagtcctataacgagcgcaacccctgttgttagttgccatcgagtaatgtcgggaactctaacaagactgccggtgcaaaccgcgaggaaggtggggatgacgtcaaatcatcacggcccttacgtcctgggccacacacgtgctacaatggtaggtacagagagcagccactgggtgaccaggagcgaatctataaagcctatcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagtccgtcaccgtaaggagcggcctagggtaaaactggtaactggggctaagtcgtaacaaggtagccgtaccggaaggtgcggctggaacacctcctttctaga

SEQ ID NO: 1447 - DNA, 1470 bp, Aquimixticola soesokkakensis
  ref <308>: DATABASE ACCESSION NUMBER: NCBI ACCESSION: NZ_FWFS01000019.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgaacggcaccttcgggtgtagtggcggacgggttagtaacgcgtgggaatgtacccttctctacggaatagtctcgggaaactggggttaataccgtatacgcccttcgggggaaagatttatcggagaaggatcagcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggatcagaaagttgggggtgaaatcccggggctcaacctcggaactgcctccaaaactactggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggatcgtagagatactttccttcagttcggctggatcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 1448 - DNA, 1155 bp, Aquisalibacillus elongatus
  ref <308>: DATABASE ACCESSION NUMBER: NCBI ACCESSION: NZ_RKRF01000005.1
  ref <309>: DATABASE ENTRY DATE: 2019-04-01
  ref <313>: RELEVANT RESIDUES IN SEQ ID NO: (1)..(1155)
tttatggagagtttgatcctggctcaggacgaacgctggcggcgtgcctaatacatgcaagtcgagcgcgggaagcagacggaatccttcgggaggatgtctgtggaacgagcggcggacgggtgagtaacacgtgggcaacctgcctgtaagactgggataactccgggaaaccggggctaataccgggtaattcatcggatcgcatgatccgttgttgaaagatggcttttgctatcacttacagatgggcccgcggcgcattagttagttggtggggtaatggcctaccaaggcgacgatgcgtagccgacctgagagggtgatcggccacactgggactgagacacggcccagactcctacgggaggcagcagtagggaatcatccgcaatggacgaaagtctgacggtgcaacgccgcgtgagtgaggaaggtcttcggatcgtaaaactctgttgttagggaagaacacgttccgtttgaataaggcggagccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccatggctcaaccatggagggtcattggaaactggggaacttgaggacagaagaggagagcggaattccacgtgtagcggtgaaatgcgtagatatgtggaggaacaccagtggcgaaggcggctctctggtctgtgcctgacgctgaggcgcgaaagcgtggggagcgaacaggattagataccctggtagtccacgccgtaaacgatgagtgctaggtgttaggggtttccacccttagtgctgcagttaacgcaataagcactccgcctggggagtacggccgcaaggctgaaactcaaaggaattgacgggggcccgcacaagcggtggagcatgtggtttaattcgacgcaacgcgaagaaccttaccaggtcttgacatcctcggaccaccctagagatagggtcttcccttcggggaccgagtgacaggtggtgcatggttgtcgtcagctcgtgtcgtgagatgttgggttaagtcccgcaacgagcgcaacccttgatcttagttgccagcatt

SEQ ID NO: 1449 - DNA, 1545 bp, Aquitalea sp. FJL05
  ref <308>: DATABASE ACCESSION NUMBER: NCBI ACCESSION: NZ_QAJS01000023.1
  ref <309>: DATABASE ENTRY DATE: 2019-04-01
  ref <313>: RELEVANT RESIDUES IN SEQ ID NO: (1)..(1545)
agattgaactgaagagtttgatcctggctcagattgaacgctggcggcatgctttacacatgcaagtcgaacggtaacagggagcttgctccgctgacgagtggcgaacgggtgagtaatgcgtcggaacgtgccgagtagtgggggataactatccgaaaggatagctaataccgcatacgctttgagaaggaaagcaggggatcgtaagaccttgcgctattcgagcggccgacgtctgattagctagttggtgaggtaagagctcaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaggaaatccctaaggttaatacccttgggggatgacagtacctgaagaataagcaccggctaactacgtgccagcagccgcggtaatacgtagggtgcaagcgttaatcggaattactgggcgtaaagcgtgcgcaggcggttgtgtaagtctgatgtgaaagccccgggctcaacctgggaactgcattggagactgcacggctagagtgcgtcagaggggggtagaattccgcgtgtagcagtgaaatgcgtagagatgcggaggaataccgatggcgaaggcagccccctgggatgacactgacgctcatgcacgaaagcgtggggagcaaacaggattagataccctggtagtccacgccctaaacgatgtcaactagctgttgggggtttgaatccttggtagcgtagctaacgcgagaagttgaccgcctggggagtacggccgcaaggttaaaactcaaaggaattgacggggacccgcacaagcggtggatgatgtggattaattcgatgcaacgcgaaaaaccttacctggtcttgacatggtcggaacttgccagagatggcttggtgctcgaaagagaaccgacacacaggtgctgcatggctgtcgtcagctcgtgtcgtgagatgttgggttaagtcccgcaacgagcgcaacccttgccattagttgctaccatttagttgagcactctaatgggactgccggtgacaaaccggaggaaggtggggatgacgtcaagtcctcatggcccttatgaccagggcttcacacgtcatacaatggtcggtacagagggtcgcgaagccgcgaggtggagccaatctcataaaaccgatcgtagtccggatcgcactctgcaactcgagtgcgtgaagtcggaatcgctagtaatcgcggatcagcatgccgcggtgaatacgttcccgggtcttgtacacaccgcccgtcacaccatgggagtgagtttcaccagaagtgggtaggctaaccgtaaggaggccgcttaccacggtgggattcatgactggggtgaagtcgtaacaaggtagccgtaggggaacctgcggctggatcacctcctttctag

SEQ ID NO: 1450 - DNA, 1074 bp, Aquitalea sp. MWU14-2217
  ref <308>: DATABASE ACCESSION NUMBER: NCBI ACCESSION: NZ_RFAR01000027.1
  ref <309>: DATABASE ENTRY DATE: 2019-04-01
  ref <313>: RELEVANT RESIDUES IN SEQ ID NO: (1)..(1074)
tgggggatgacagtacctgaagaataagcaccggctaactacgtgccagcagccgcggtaatacgtagggtgcaagcgttaatcggaattactgggcgtaaagcgtgcgcaggcggttgtgtaagtctgatgtgaaagccccgggctcaacctgggaactgcattggagactgcacggctagagtgcgtcagaggggggtagaattccgcgtgtagcagtgaaatgcgtagagatgcggaggaataccgatggcgaaggcagccccctgggatgacactgacgctcatgcacgaaagcgtggggagcaaacaggattagataccctggtagtccacgccctaaacgatgtcaactagctgttgggggtttgaatccttggtagcgtagctaacgcgagaagttgaccgcctggggagtacggccgcaaggttaaaactcaaaggaattgacggggacccgcacaagcggtggatgatgtggattaattcgatgcaacgcgaaaaaccttacctggtcttgacatgtacggaacttgccagagatggcttggtgctcgaaagagagccgtaacacaggtgctgcatggctgtcgtcagctcgtgtcgtgagatgttgggttaagtcccgcaacgagcgcaacccttgccattagttgctaccattcagttgagcactctaatgggactgccggtgacaaaccggaggaaggtggggatgacgtcaagtcctcatggcccttatgaccagggcttcacacgtcatacaatggtcggtacagagggtcgcgaagccgcgaggtggagccaatctcataaaaccgatcgtagtccggatcgcactctgcaactcgagtgcgtgaagtcggaatcgctagtaatcgcggatcagcatgccgcggtgaatacgttcccgggtcttgtacacaccgcccgtcacaccatgggagtgagtttcaccagaagtgggtaggctaaccgtaaggaggccgcttaccacggtgggattcatgactggggtgaagtcgtaacaaggtagccgtaggggaacctgcggctggatcacctcctttctag

SEQ ID NO: 1451 - DNA, 1530 bp, Arachidicoccus sp. KIS59-12
  ref <308>: DATABASE ACCESSION NUMBER: NCBI ACCESSION: NZ_CP032489.1
  ref <309>: DATABASE ENTRY DATE: 2019-04-01
  ref <313>: RELEVANT RESIDUES IN SEQ ID NO: (1)..(1530)
tggagagtttgatcctggctcaggatgaacgctagcggcaggcttaatacatgcaagtcgaggggtaacacgaagtagcaatattttggtgacgaccggcaaacgggtgcggaacacgtgcgaaactttcccttatctgggagatagcccgaagaaattcggattaatatcccataacatatttagatggcatcatttgaatattaaaactccggtggataaggatggtcgcgcgtatgattaggtagttggcggggtaacggcccaccaagcctacgatcattagctgatgtgagagcatgatcagccacacgggcactgagacacgggcccgactcctacgggaggcagcagtaaggaatattggtcaatggacgcaagtctgaaccagccatgccgcgtgaaggatgaaggtcctctggattgtaaacttcttttatagggggcgaaacactttttatctaaagagcttgacagtaccctatgaataagcaccggctaactccgtgccagcagccgcggtaatacggagggtgcaagcgttatccggatttactgggtttaaagggtgcgtaggcggatttgtaagtccgaggtgaaatctccgagcttaactcggaaactgccttggatactataagtcttgaatgacgttgaggttagcggaatatgtcatgtagcggtgaaatgcttagatatgacatagaacatctattgcgaaggcagctaactaagcgtaaattgacgctgatgcacgaaagcgtggggatcaaacaggattagataccctggtagtccacgccctaaacgatgattactcgacgtgcgcgatacacagtgcgcgtctgagcgaaagcattaagtaatccacctgggaagtacgttcgcaagaatgaaactcaaaggaattggcgggggtccgcacaagcggtggagtatgtggtttaattcgatgatacgcgaggaaccttacctgggctagaatgcgaatgaccgttcctgaaagggaattttctagcaatagacatgaagcaaggtgctgcatggctgtcgtcagctcgtgccgtgaggtgttgggttaagtcccgcaacgagcgcaacccctatcattagttgccaacaggttaagctgggaactctaatgagactgccgtcgtaagacgcgaggaaggaggggatgatgtcaagtcatcatggcctttatgcccagggctacacacgtactacaatgggggggacaaagagcagccacttggcgacaaggcgctaatctcaaaaaccctctctcagttcggatcgcagtctgcaactcgactgcgtgaagctggaatcgctagtaatcgtatatcagcaatgatacggtgaatacgttcccggaccttgcacacaccgcccgtcaagccatgaaagctgggtgtacctaaagtcggtaaccgtaaggagctgcctagggtaaaaccggtaattggggctaagtcgtaacaaggtagccgtaccggaaggtgcggctggaatacctcctttttagag

SEQ ID NO: 1452 - DNA, 1492 bp, Arboricoccus pini
  ref <308>: DATABASE ACCESSION NUMBER: NCBI ACCESSION: NZ_FYEH01000026.1
  ref <309>: DATABASE ENTRY DATE: 2019-04-01
  ref <313>: RELEVANT RESIDUES IN SEQ ID NO: (1)..(1492)
atgaatctgagagtttgatcctggctcagaacgaacgctggcggcgcgcctaacacatgcaagtcgagcgcctcgcaagaggagcggcggacgggtgagtaacgcgtgggaacctgccctttggtctggaacaaccgcgggaaactgcggctaatgccggatattccctgtgggggaaagatttatcgccaaaggatgggcccgcgtccgattagcttgttggtggggtaatggcctaccaaggcatcgatcggtagctggtctgagaggatgaccagccacactgggactgagacacggcccagactcctacgggaggcagcagtggggaatcttggacaatgggcgcaagcctgatccagcgacgccgcgtgggtgatgaaggccttcgggttgtaaagcccttttcccagggaagatgatgacggtacctggggaataagcaccggctaactccgtgccagcagccgcggtaagacggagggtgctagcgttgttcggaatcactgggcgtaaagggcgcgtaggcggcctgttaagtcggatgtgaaagcccggggctcaaccccggaactgcatccgagactggcaggcttgagaccgggagaggagggtggaatatccagtgtagaggtgaaattcgtagatattggatggaacaccggtggcgaaagcggctctctggcccggatctgacgctgaggcgcgaaagcgtggggagcaaacaggattagataccctggtagtccacgccctaaacgatgtgtgctagatgtcggggggcttgcccttcggtgtcggagctaacgtgttaagcacaccgcctgggaagtacggccgcaaggttaaaactcaaaggaattgacgggggcccgcacaagcggtggagcatgtggtttaattcgacgcaacgcgcagaaccttaccagcctttgacatggtagctgcgaccttgagagatcttggtttcccgcaagggggctatcacaggtgctgcatggctgtcgtcagctcgtgtcgtgagatgttgggttaagtcccgcaacgagcgcaacccttacttctagttgccagcggtatcggccgggcactctagagggactgccggtgacaagccggaggaaggtggggatgacgtcaagtcctcatggcccttacgggctgggctacacacgtgctacaatggtggtgacagtgggcagcgaaggggcgacctggagctaatccccaaaagccacctcagttcggattgcaggctgcaactcgcctgcatgaaggtggaatcgctagtaatcgtggatcagcatgccacggtgaatacgttcccgggccttgtacacaccgcccgtcacaccatgggagttggttctaccttaagccggtgggctaaccgcgcaagcggaggcagccgtccacggtcgggtcagcgactggggtgaagtcgtaacaaggtagccgtaggggaacctgcggctggatcacctcctttcta

SEQ ID NO: 1453 - DNA, 1538 bp, Arcanobacterium sp. Marseille-P5647
  ref <308>: DATABASE ACCESSION NUMBER: NCBI ACCESSION: NZ_UWOS01000004.1
  ref <309>: DATABASE ENTRY DATE: 2019-04-01
  ref <313>: RELEVANT RESIDUES IN SEQ ID NO: (1)..(1538)
tttgtggagagtttgatcctggctcaggacgaacgctggcggcgtgcttaacacatgcaagtcgaacgatgaagactggagcttgctttggttggattagtggcgaacgggtgagtaatacgtgagtaacctgccctcttctttgggataagccttggaaacggggtctaatactggatattctgcaatggtcgcatggttgttgttggaaaggtttttctggtgggggatgggctcacggcctatcagcttgttggtggggtgatggcctaccaaggcttcgacgggtagccggcctgagagggtgaccggccacattgggactgagatacggcccagactcctacgggaggcagcagtggggaatattgcacaatggacgcaagtctgatgcagcgacgccgcgtgggggatgaaggctttcgggttgtaaactccttttaacactgaacaaggcttttgttgagggtaggtgttgaataagcgccggctaactacgtgccagcagccgcggtaatacgtagggcgcgagcgttgtccggaattattgggcgtaaagagctcgtaggcggtttgtcgcgtctgctgtgaaagaccggggcttaactccggggctgcagtgggtacgggcagactagagtgcggtaggggtaactggaattcctggtgtagcggtggaatgcgcagatatcaggaggaacaccgatggcgaaggcaggttactgggctgttactgacgctgaggagcgaaagcatggggagcgaacaggattagataccctggtagtccatgccgtaaacgttgggcactaggtgtggggccttatccacaggttctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacactgcgatgttctagagatagggcagccttcggggtggtgtacaggtggtgcatggttgtcgtcagctcgtgtcgtgagatgttgggttaagtcccgcaacgagcgcaacccttgtcttgtgttgccagcacgttatggtggggactcacgagagactgccggggttaactcggaggaaggtggggatgacgtcaaatcatcatgccccttatgtcttgggcttcacgcatgctacaatggccggtacagagggttgcgatactgtgaggtggagcgaatcccttaaagccggtctcagttcggattggggtctgcaactcgaccccatgaagtcggagtcgctagtaatcgcagatcagcaacgctgcggtgaatacgttctcgggccttgtacacaccgcccgtcacgtcacgaaagttggtaacacccgaagctcatggcctaaccgttttgcggggggagtggtcgaaggtgggactagcgattgggacgaagtcgtaacaaggtagccgtaccggaaggtgcggctggatcacctcctttctagggag

SEQ ID NO: 1454 - DNA, 1507 bp, Arcicella aurantiaca
  ref <308>: DATABASE ACCESSION NUMBER: NCBI ACCESSION: NZ_QGGO01000065.1
  ref <309>: DATABASE ENTRY DATE: 2019-04-01
  ref <313>: RELEVANT RESIDUES IN SEQ ID NO: (1)..(1507)
tttacaatggagagtttgatcctggctcaggatgaacgctagcggcaggcctaatacatgcaagtcgaacggtgtagcaatacatagtggcgcacgggtgcgtaacacgtatgcaacctaccttatactgggggatagcctttggaaacggagattaataccccatagtacatttagatggcatcatttgaatgttaaagatttatcggtataagctgggcatgcgtccaattagttagttggtgaggtaacggctcaccaagactttgattggtaggggaactgagaggttaatcccccacactggcactgagatacgggccagactcctacgggaggcagcagtagggaatattgggcaatggaggcaactctgacccagccatgccgcgtgcaggatgaaggcgttatgcgttgtaaactgcttttatataggaagaaatagtccttgcgaggaaagttgacggtactatatgaataagcaccggctaactccgtgccagcagccgcggtaatacggagggtgcaagcgttgtccggatttattgggtttaaagggtgcgtaggcggtttattaagtcagtggtgaaagacggtcgctcaacgattgcagtgccattgatactggtagacttgagtgggattgaggtagctggaatggatagtgtagcggtgaaatgcatagatattatccagaacaccaattgcgtaggcaagttactaagtctcaactgacgctgaggcacgaaagtgtgggtatcaaacaggattagataccctggtagtccacactgtaaacgatgataactaactgttggcttttgggtcagtggtacagagaaatcgttaagttatccacctggggagtacgccggcaacggtgaaactcaaaggaattgacgggggtccgcacaagcggtggagcatgtggtttaattcgatgatacgcgaggaaccttacctaggctagaatgtgaaggaatgtatcagaaatggtgcagtcagcaatgacctgaaacaaggtgctgcatggctgtcgtcagctcgtgccgtgaggtgttgggttaagtcccgcaacgagcgcaacccctgttgttagttgccatcaggtaatgctgggaactctaacaagactgcctacgcaagtagagaggaaggaggggacgacgtcaagtcatcatggcccttacgcctagggcaacacacgtgctacaatggacggtacagcaggtcgctatgtggtaacacaatgccaatctctaaagccgttctcagttcggattggggtctgcaactcgaccctatgaagctggaatcgctagtaatcggatatcagctatgatccggtgaatacgttcccggaccttgtacacaccgcccgtcaagccatgaaagtctggtagacctaaagctggttgtcaaaacaccagttagggtagaacaggtaattggggctaagtcgtaacaaggtagccgtaccggaaggtgtggctggaacacctccttt

SEQ ID NO: 1455 - DNA, 1521 bp, Arcobacter anaerophilus
  ref <308>: DATABASE ACCESSION NUMBER: NCBI ACCESSION: NZ_PDKO01000024.1
  ref <309>: DATABASE ENTRY DATE: 2019-04-01
  ref <313>: RELEVANT RESIDUES IN SEQ ID NO: (1)..(1521)
tttatggagagtttgatcctggctcagagtgaacgctggcggcgtgcctaacacatgcaagtcgaacgagaacggattaaagcttgctttaattgtcagctaagtggcgcacgggtgagtaatgtatagttaacctgccctagagagagggataacagatggaaacgtctgctaagacctcatatgcctttaaaacaaaagtttgcaagggaaatatttatagctctaggatgggactgtattgtatcagttagttggtgaggtaatggctcaccaagacaatgacgcataactggtttgagaggatgatcagtcacactggaactgagacacggtccagactcctacgggaggcagcagtggggaatattgcacaatggaggaaactctgatgcagcaacgccgcgtggaggatgacacttttcggagcgtaaactccttttatataggaagataatgacggtactatatgaataagcaccggctaactccgtgccagcagccgcggtaatacggagggtgcaagcgttactcggaatcactgggcgtaaagagcgtgtaggcggatagataagtcagaagtgaaatccaatagctcaactattgaactgcttttgaaactgtctatctagagtatgggagaggtagatggaatttctggtgtaggggtaaaatccgtagagatcagaaggaataccgattgcgaaggcgatctactggaacattactgacgctgagacgcgaaagcgtggggagcaaacaggattagataccctggtagtccacgccctaaacgatgtgcactagttgttgcgatgctagacattgcagtaatgcagtaaacacattaagtgcaccgcctggggagtacggtcgcaagattaaaactcaaaggaatagacggggacccgcacaagcggtggagcatgtggtttaattcgacgatacgcgaagaaccttacctggacttgacatagtaagaaccatttagagatagatgggtgtctgcttgcagaaacttatatacaggtgctgcacggctgtcgtcagctcgtgtcgtgagatgttgggttaagtcccgcaacgagcgcaacccacgtcattagttgctaacacttcgggtgagaactctaatgagactgcctacgcaagtaggaggaaggtgtggacgacgtcaagtcatcatggcccttacgtccagggctacacacgtgctacaatggagtatacaaagagcagcaataccgtgaggtggagcaaatcttaaaaatacttcccagttcggatagtagtctgcaactcgactacttgaagttggaatcgctagtaatcgtagatcagcaatgctacggtgaatacgttcccgggtcttgtactcaccgcccgtcacaccatgggagttgaactcattcgaagcggggatgctaaactagctaccctccacagtggattcagcgactggggtgaagtcgtaacaaggtaaccgtaggagaacctgcggttggatcacctcctttcaga

SEQ ID NO: 1456 - DNA, 1519 bp, Arcobacter aquimarinus
  ref <308>: DATABASE ACCESSION NUMBER: NCBI ACCESSION: NZ_NXIJ01000027.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacggattatagcttgctataattgtcagctaagtggcgcacgggtgagtaatgtatagataacctgccctctagaaaggaataacagatggaaacgtctgctaatgccctatatgcctttaatacataagtatgcaagggaaacgctttagtgctagaggatgggtctgtatggtatcagtttgttggtgaggtaatggctcaccaagactatgacgcctaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataggaagataatgacggtactatatgaataagcaccggctaactccgtgccagcagccgcggtaatacggagggtgcaagcgttactcggaatcactgggcgtaaagagcgtgtaggcgggtatataagtcagaagtgaaatcctatagcttaactatagaactgcttttgaaactgtatacctagaatgtgggagaggtagatggaatttctggtgtaggggtaaaatccgtagagatcagaaggaataccgattgcgaaggcgatctactggaacattattgacgctgagacgcgaaagcgtggggagcaaacaggattagataccctggtagtccacgccctaaacgatgtacactagttgttgtgaggctcgaccttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtcattagttgctaacagttcggctgagaactctaatgagactgcctacgcaagtaggaggaaggtgaggacgacgtcaagtcatcatggcccttacgtccagggctacacacgtgctacaatggggtatacaaagagcagcaataccgcgaggtggagcaaatctcaaaaatatctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaaatagctaccttccacagtggattcagcgactggggtgaagtcgtaacaaggtaaccgtaggagaacctgcggttggatcacctcctttc

SEQ ID NO: 1457 - DNA, 1519 bp, Arcobacter bivalviorum
  ref <308>: DATABASE ACCESSION NUMBER: NCBI ACCESSION: NZ_PDKL01000016.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcctaacacatgcaagtcgaacgagaacggacttaagcttgcttaagttgtcagctaagtggcgcacgggtgagtaatgtatagttaacctgccctctagaaaggaataacagttggaaacgactgctaatgccctatatgcccataatacataagtatgctggggaaacgctttagtgctagaggatgggactgtatggtatcagatagttggtgaggtaatggctcaccaagtcaatgacgcctaactggtttgagaggatgatcagtcacactggaactgagacacggtccagactcctacgggaggcagcagtggggaatattgcacaatggaggaaactctgatgcagcaacgccgcgtggaggatgacacttttcggagcgtaaactccttttatataggaagataatgacggtactatatgaataagcaccggctaactccgtgccagcagccgcggtaatacggagggtgcaagcgttactcggaatcactgggcgtaaagagcgtgtaggcgggttattaagtcagaagtgaaatcctatggctcaaccatagaactgcttttgaaactggtaacctagagtatgggagaggtagatggaatttctggtgtaggggtaaaatccgtagagatcagaaggaataccgattgcgaaggcgatctactggaacattactgacgctgagacgcgaaagcgtggggagcaaacaggattagataccctggtagtccacgccctaaacgatgtacactagttgttgccatgctagacatggcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggacttgacatttacagaactttcaagagattgattggtgtctgcttgcagaaactgtaggacaggtgctgcacggctgtcgtcagctcgtgtcgtgagatgttgggttaagtcccgcaacgagcgcaacccacgtcgttagttgctaacagttcggctgagaactctaacgagactgcctgggcaaccaggaggaaggtgtggacgacgtcaagtcatcatggcccttacgtccagggctacacacgtgctacaatggggtatacaaagagccgcaataccgcgaggtggagcaaatctcaaaaatatctcccagttcggattgtactctgcaactcgagtgcatgaagttggaatcgctagtaatcgtagatcagcaatgctacggtgaatacgttcccgggtcttgtactcaccgcccgtcacaccatgggagttgaactcattcgaagcggggatgctaagatagctaccctccacagtggattcagcgactggggtgaagtcgtaacaaggtaaccgtaggtgaacctgcggttggatcacctcctttc

SEQ ID NO: 1458 - DNA, 1519 bp, Arcobacter canalis
  ref <308>: DATABASE ACCESSION NUMBER: NCBI ACCESSION: NZ_NWVW01000030.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacgggattagcttgctaatctgtcagctaagtggcgcacgggtgagtaatatataggtaacgtgccttcaagagggggataacagatggaaacgtctgctaaaaccccatatgcctttaatgcgaaagtatgcaagggaaatatttatagcttgaagatcggcctgtacagtatcagatagttggtgaggtaatagctcaccaagtcaatgacgcttaactggtttgagaggatgatcagtcacactggaactgagacacggtccagactcctacgggaggcagcagtggggaatattgcacaatgggggaaaccctgatgcagcaacgccgcgtggaggatgacacatttcggtgcgtaaactccttttatataagaagataatgacggtattatatgaataagcaccggctaactccgtgccagcagccgcggtaatacggagggtgcaagcgttactcggaatcactgggcgtaaagagcgtgtaggcggatagataagtcagaagtgaaatccaatagcttaactattgaactgcttttgaaactgtctatctagagtatgggagaggtagatggaatttctggtgtaggggtaaaatccgtagagatcagaaggaataccgattgcgaaggcgatctactggaacataactgacgctgagacgcgaaagcgtggggagcaaacaggattagataccctggtagtccacgccctaaacgatgtacactagttgttgctatgctcgacatagcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggtcttgacatagtaagaaccatttagagatagatgggtgtctgcttgcagaaacttatatacaggtgctgcacggctgtcgtcagctcgtgtcgtgagatgttgggttaagtcccgcaacgagcgcaaccctcgtcattagttgctaacacttcgggtgagaactctaatgagactgcctacgcaagtaggaggaaggtgaggacgacgtcaagtcatcatggcccttacgaccagggctacacacgtgctacaatggggtatacaaagagcagcgatacagtgatgtggagcaaatctaaaaaatacctcccagttcggattgtagtctgcaactcgactacatgaagttggaatcgctagtaatcgtagatcagcaatgctacggtgaatacgttcccgggtcttgtactcaccgcccgtcacaccatgggagttgatttcactcgaagcggggatgctaagatagctaccctccacagtggaattagcgactggggtgaagtcgtaacaaggtaaccgtaggagaacctgcggttggatcacctcctttcaga

SEQ ID NO: 1459 - DNA, 1519 bp, Arcobacter cibarius
  ref <308>: DATABASE ACCESSION NUMBER: NCBI ACCESSION: NZ_JABW01000041.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacgggttatagcttgctataattgtcagctaagtggcgcacgggtgagtaatgtataggtaatatgcctcttactaagggataacaaatggaaacgtttgctaataccttatactccttactaactaaagttagtaagggaaagatttattggtaagagattagcctgtattgtatcagttagttggtggggtaatggcctaccaagacaatgacgcataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataagaagataatgacggtattatatgaataagcaccggctaactccgtgccagcagccgcggtaatacggggggtgcaagcgttactcggaatcactgggcgtaaagagcatgtaggcggattaataagtttgaagtgaaatcctatagcttaactatagaactgctttgaaaactgttagtctagaatgtgggagaggtagatggaatttctggtgtaggggtaaaatccgtagagatcagaaggaataccgattgcgaaggcgatctactggaacattattgacgctgagatgcgaaagcgtggggagcaaacaggattagataccctggtagtccacgccctaaacgatgtacactagttgttgtgagacttgatcttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtccttagttgctaacagttcggctgagaactctaaggagactgcctacgcaagtaggaggaaggtgaggacgacgtcaagtcatcatggcccttacgtccagggctacacacgtgctacaatgggatatacaatgagccgcaatacggtgacgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaagtagctaccttccacagtggattcagcgactggggtgaagtcgtaacaaggtaaccgtaggagaacctgcggttggatcacctcctttc

SEQ ID NO: 1460 - DNA, 1519 bp, Arcobacter cloacae
  ref <308>: DATABASE ACCESSION NUMBER: NCBI ACCESSION: NZ_PDJZ01000027.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacggattatagcttgctataattgtcagctaagtggcgcacgggtgagtaatgtatagataacctgcccttaagaaaggaataacagttggaaacgactgctaatgccctatatgcctttaatacataagtatgcaagggaaacgctttagtgcttaaggatgggtctgtatggtatcagcttgttggtgaggtaatggctcaccaaggctatgacgcctaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataggaagataatgacggtactatatgaataagcaccggctaactccgtgccagcagccgcggtaatacggagggtgcaagcgttactcggaatcactgggcgtaaagagcgtgtaggcgggtatataagtcagaagtgaaatccaatagcttaactattgaactgcttttgaaactgtatacctagaatgtgggagaggtagatggaatttctggtgtaggggtaaaatccgtagagatcagaaggaataccgattgcgaaggcgatctactggaacattattgacgctgagacgcgaaagcgtggggagcaaacaggattagataccctggtagtccacgccctaaacgatgtacactagttgttgtgaggctcgaccttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtcattagttgctaacagttcggctgagaactctaatgagactgcctacgcaagtaggaggaaggtgaggacgacgtcaagtcatcatggcccttacgtccagggctacacacgtgctacaatggggtatacaaagagcagcaatacggtgacgtggagcaaatctcaaaaatatctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaagtagctaccttccacagtggattcagcgactggggtgaagtcgtaacaaggtaaccgtaggagaacctgcggttggatcacctcctttc

SEQ ID NO: 1461 - DNA, 1519 bp, Arcobacter cryaerophilus
  ref <308>: DATABASE ACCESSION NUMBER: NCBI ACCESSION: NZ_CP032823.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacggattatagcttgctataattgtcagctaagtggcgcacgggtgagtaatgtataggtaatatgcctcttactaagggataacaattggaaacgattgctaataccttatactccttgttaacttaagttaataagggaaagatttattggtaagagattagcctgtattgtatcagttagttggtggggtaatggcctaccaagacaatgacacataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatatgagaagataatgacggtattatatgaataagcaccggctaactccgtgccagcagccgcggtaatacggggggtgcaagcgttactcggaatcactgggcgtaaagagcatgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacattattgacgctgagatgcgaaagcgtggggagcaaacaggattagataccctggtagtccacgccctaaacgatgtacactagttgttgtgagacttgatcttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtgtttagttgctaacagttcggctgagaactctaaacagactgcctacgcaagtaggaggaaggtgaggacgacgtcaagtcatcatggcccttacgtccagggctacacacgtgctacaatgggatatacaaagagccgcaatacggtgacgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagtcgaactcattcgaagcggggatgctaaaatagctaccttccacagtggatttggcgactggggtgaagtcgtaacaaggtaaccgtaggagaacctgcggttggatcacctcctttc

SEQ ID NO: 1462 - DNA, 1519 bp, Arcobacter defluvii
  ref <308>: DATABASE ACCESSION NUMBER: NCBI ACCESSION: NZ_NXIH01000027.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacggattatagcttgctataattgtcagctaagtggcgcacgggtgagtaatgtatagataacctgccctctagaaaggaataacagatggaaacgtctgctaatgccctatatgcctttaatacataagtatgcaagggaaacgctttagtgctagaggatgggtctgtatggtatcagcttgttggtgaggtaatggctcaccaaggcaatgacgcctaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataggaagataatgacggtactatatgaataagcaccggctaactccgtgccagcagccgcggtaatacggagggtgcaagcgttactcggaatcactgggcgtaaagagcgtgtaggcgggtatataagtcagaagtgaaatccaatagcttaactattgaactgcttttgaaactgtatacctagaatgtgggagaggtagatggaatttctggtgtaggggtaaaatccgtagagatcagaaggaataccgattgcgaaggcgatctactggaacattattgacgctgagacgcgaaagcgtggggagcaaacaggattagataccctggtagtccacgccctaaacgatgtacactagttgttgtgaggctcgaccttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtcattagttgctaacagttcggctgagaactctaatgagactgcctacgcaagtaggaggaaggtgaggacgacgtcaagtcatcatggcccttacgtccagggctacacacgtgctacaatggggtatacaaagagcagcaatacagtgatgtggagcaaatctcaaaaatatctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaagtagctaccttccacagtggattcagcgactggggtgaagtcgtaacaaggtaaccgtaggagaacctgcggttggatcacctcctttc

SEQ ID NO: 1463 - DNA, 1519 bp, Arcobacter ebronensis
  ref <308>: DATABASE ACCESSION NUMBER: NCBI ACCESSION: NZ_PDKK01000026.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcctaacacatgcaagtcgaacgagaacggggtaaagcttgctttacttgtcagctaagtggcgcacgggtgagtaatgtatagttaacctgccctcaagaaaggaataacagatggaaacgtctgctaatgccctatatgcccataatacaaaagtatgctggggaaacgctttagtgcttgaggatgggactgtattgtatcagttagttggtgaggtaatggctcaccaagacaatgacgcataactggtttgagaggatgatcagtcacactggaactgagacacggtccagactcctacgggaggcagcagtggggaatattgcacaatggaggaaactctgatgcagcaacgccgcgtggaggatgacacttttcggagcgtaaactccttttatataggaagataatgacggtactatatgaataagcaccggctaactccgtgccagcagccgcggtaatacggagggtgcaagcgttactcggaatcactgggcgtaaagagcgtgtaggcggatagataagtcagaagtgaaatccaatagctcaactattgaactgcttttgaaactgtctatctagagtatgggagaggtagatggaatttctggtgtaggggtaaaatccgtagagatcagaaggaataccgattgcgaaggcgatctactggaacattactgacgctgagacgcgaaagcgtggggagcaaacaggattagataccctggtagtccacgccctaaacgatgtgcactagttgttgcgatgctagacattgcagtaatgcagtaaacacattaagtgcaccgcctggggagtacggtcgcaagattaaaactcaaaggaatagacggggacccgcacaagcggtggagcatgtggtttaattcgacgatacgcgaagaaccttacctggacttgacatttacagaactttctagagatagattggtgtctgcttgcagaaactgtaggacaggtgctgcacggctgtcgtcagctcgtgtcgtgagatgttgggttaagtcccgcaacgagcgcaacccacgtcgttagttgctaacagttcggctgagaactctaacgagactgcctacgcaagtaggaggaaggtgtggacgacgtcaagtcatcatggcccttacgtccagggctacacacgtgctacaatggggcatacaaagagctgcaatatcgtgaggtggagcaaatctcaaaaatgcctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaagtagctaccctccacagtggattcagcgactggggtgaagtcgtaacaaggtaaccgtaggagaacctgcggttggatcacctcctttc

SEQ ID NO: 1464 - DNA, 1519 bp, Arcobacter ellisii
  ref <308>: DATABASE ACCESSION NUMBER: NCBI ACCESSION: NZ_NXIG01000024.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacggattatagcttgctataattgtcagctaagtggcgcacgggtgagtaatgtatagataacctgcccttaagaaaggaataacagttggaaacgactgctaatgccctatatgcctttaatacataagtatgcaagggaaacgctttagtgcttaaggatgggtctgtatggtatcagcttgttggtgaggtaatggctcaccaaggctatgacgcctaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataggaagataatgacggtactatatgaataagcaccggctaactccgtgccagcagccgcggtaatacggagggtgcaagcgttactcggaatcactgggcgtaaagagcgtgtaggcgggtatataagtcagaagtgaaatccaatagctcaactattgaactgcttttgaaactgtatacctagaatgtgggagaggtagatggaatttctggtgtaggggtaaaatccgtagagatcagaaggaataccgattgcgaaggcgatctactggaacattattgacgctgagacgcgaaagcgtggggagcaaacaggattagataccctggtagtccacgccctaaacgatgtacactagttgttgtgaggctcgaccttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtccttagttgctaacagttcggctgagaactctaaggagactgcctacgcaagtaggaggaaggtgaggacgacgtcaagtcatcatggcccttacgtccagggctacacacgtgctacaatggggtatacaaagagcagcaatacggtgacgtggagcaaatctcaaaaatatctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaagtagctaccttccacagtggattcagcgactggggtgaagtcgtaacaaggtaaccgtaggagaacctgcggttggatcacctcctttc

SEQ ID NO: 1465 - DNA, 1519 bp, Arcobacter halophilus
  ref <308>: DATABASE ACCESSION NUMBER: NCBI ACCESSION: NZ_PDJY01000067.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacgggattagcttgctaatctgtcagctaagtggcgcacgggtgagtaatatataggtaacgtgccttcaagagggggataacagatggaaacgtctgctaagaccccatatgcctttaatacaaaagtatgaaagggaaatatttatagcttgaagatcggcctgtacagtatcagatagttggtgaggtaatggctcaccaagtcaatgacgcttaactggtttgagaggatgatcagtcacactggaactgagacacggtccagactcctacgggaggcagcagtggggaatattgcacaatgggggaaaccctgatgcagcaacgccgcgtggaggatgacacatttcggtgcgtaaactccttttatataagaagataatgacggtattatatgaataagcaccggctaactccgtgccagcagccgcggtaatacggagggtgcaagcgttactcggaatcactgggcgtaaagagcgtgtaggcggatagataagtcagaagtgaaatccaatagcttaactattgaactgcttttgaaactgtctatctagagtatgggagaggtagatggaatttctggtgtaggggtaaaatccgtagagatcagaaggaataccgattgcgaaggcgatctactggaacataactgacgctgagacgcgaaagcgtggggagcaaacaggattagataccctggtagtccacgccctaaacgatgtacactagttgttgctatgctcgacatagcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggtcttgacatagtaagaaccatttagagatagatgggtgtctgcttgcagaaacttatatacaggtgctgcacggctgtcgtcagctcgtgtcgtgagatgttgggttaagtcccgcaacgagcgcaaccctcgtcattagttgctaacacttcgggtgagaactctaatgagactgcctacgcaagtaggaggaaggtgaggacgacgtcaagtcatcatggcccttacgaccagggctacacacgtgctacaatggggtatacaaagagcagcgatacagtgatgtggagcaaatctaaaaaatacctcccagttcggattgtagtctgcaactcgactacatgaagttggaatcgctagtaatcgtagatcagcaatgctacggtgaatacgttcccgggtcttgtactcaccgcccgtcacaccatgggagttgatttcactcgaagcggggatgctaagatagctaccctccacagtggaattagcgactggggtgaagtcgtaacaaggtaaccgtaggagaacctgcggttggatcacctcctttcaga

SEQ ID NO: 1466 - DNA, 1519 bp, Arcobacter lanthieri
  ref <308>: DATABASE ACCESSION NUMBER: NCBI ACCESSION: NZ_KK241005.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacgggctatagcttgctatagttgtcagctaagtggcgcacgggtgagtaatgtataggtaatatgcctcttactaagggataacaaatggaaacgtttgctaataccttatattccttataaacaaaagtttataagggaaagatttattggtaagagattggcctgtattgtatcagttagttggtggggtaatggcctaccaagacaatgacgcataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataagaagatgatgacggtattatatgaataagcaccggctaactccgtgccagcagccgcggtaatacggggggtgcaagcgttactcggaatcactgggcgtaaagagcatgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacattattgacgctgagatgcgaaagcgtggggagcaaacaggattagataccctggtagtccacgccctaaacgatgtacactagttgttgtgagactagatcttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaatgatttagagatagattagtgtctgcttgcagaaacttgcatacaggtgctgcacggctgtcgtcagctcgtgtcgtgagatgttgggttaagtcccgcaacgagcgcaaccctcgtcgttagttgctaacagttcggctgagaactctaacgagactgcctacgcaagtaggaggaaggtgaggatgacgtcaagtcatcatggcccttacgtccagggctacacacgtgctacaatgggatatacaaagagcagcaatacagtgatgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaagtagctaccttccacagtggattcagcgactggggtgaagtcgtaacaaggtaaccgtaggagaacctgcggttggatcacctcctttc

SEQ ID NO: 1467 - DNA, 1521 bp, Arcobacter lekithochrous
  ref <308>: DATABASE ACCESSION NUMBER: NCBI ACCESSION: NZ_PZYW01000019.1
  ref <309>: DATABASE ENTRY DATE: 2019-04-01
  ref <313>: RELEVANT RESIDUES IN SEQ ID NO: (1)..(1521)
tttatggagagtttgatcctggctcagagtgaacgctggcggcgtgcttaacacatgcaagtcgaacgagaacgggttatagtttactataactgtcagctaagtggcgcacgggtgagtaatatataggtaacgtgccctagagagggggataacatttggaaacgaatgctaataccccatatgcctttaagtcttaagactgcaagggaaatatttatagctctaggatcggcctgtacggtatcagtttgttggtgaggtaatggctcaccaagactatgacgcctaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataggaagataatgacggtactatatgaataagcaccggctaactccgtgccagcagccgcggtaatacggagggtgcaagcgttactcggaatcactgggcgtaaagagcgtgtaggcgggtttgtaagtttgaagtgaaatccaatggctcaaccattgaactgctttgaaaactgcttacctagaatatgggagaggtagatggaatttctggtgtaggggtaaaatccgtagagatcagaaggaataccgattgcgaaggcgatctactggaacattattgacgctgagacgcgaaagcgtggggagcaaacaggattagataccctggtagtccacgccctaaacgatgtacactagttgttgtgaggctagaccttgcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggacttgacatagaaagaataacgcagagatgtgatagtgctagcttgctagaactttcatacaggtgctgcacggctgtcgtcagctcgtgtcgtgagatgttgggttaagtcccgcaacgagcgcaaccctcgtcgttagttgctaacagttcggctgagaactctaacgagactgcctgggtaaccaggaggaaggtgaggacgacgtcaagtcatcatggcccttacgtccagggctacacacgtgctacaatggggcatacaaagagcagcgataccgcgaggtggagcaaatctcaaaaatgcctcccagttcggatagtagtctgcaactcgactacttgaagttggaatcgctagtaatcgtagatcagcaatgctacggtgaatacgttcccgggtcttgtactcaccgcccgtcacaccatgggagttgaactcattcgaagcggggatgctaaagtagctaccctccacagtggattcagcgactggggtgaagtcgtaacaaggtaaccgtaggagaacctgcggttggatcacctcctttcaga

SEQ ID NO: 1468 - DNA, 1519 bp, Arcobacter marinus
  ref <308>: DATABASE ACCESSION NUMBER: NCBI ACCESSION: NZ_FUYO01000053.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacgggattagcttgctaatctgtcagctaagtggcgcacgggtgagtaatatataggtaacgtgccttcaagagggggataacagatggaaacgtctgctaaaaccccatatgcctttaatacgaaagtatgcaagggaaatatttatagcttgaagatcggcctgtacagtatcagatagttggtgaggtaatagctcaccaagtcaatgacgcttaactggtttgagaggatgatcagtcacactggaactgagacacggtccagactcctacgggaggcagcagtggggaatattgcacaatgggggaaaccctgatgcagcaacgccgcgtggaggatgacacatttcggtgcgtaaactccttttatataagaagataatgacggtattatatgaataagcaccggctaactccgtgccagcagccgcggtaatacggagggtgcaagcgttactcggaatcactgggcgtaaagagcgtgtaggcggatagataagtcagaagtgaaatccaatagcttaactattgaactgcttttgaaactgtctatctagagtatgggagaggtagatggaatttctggtgtaggggtaaaatccgtagagatcagaaggaataccgattgcgaaggcgatctactggaacataactgacgctgagacgcgaaagcgtggggagcaaacaggattagataccctggtagtccacgccctaaacgatgtacactagttgttgccatgctcgacatggcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggtcttgacatagtaagaaccatttagagatagatgggtgtctgcttgcagaaacttatatacaggtgctgcacggctgtcgtcagctcgtgtcgtgagatgttgggttaagtcccgcaacgagcgcaaccctcgtcattagttgctaacacttcgggtgagaactctaatgagactgcctacgcaagtaggaggaaggtgaggacgacgtcaagtcatcatggcccttacgaccagggctacacacgtgctacaatggggtatacaaagagcagcgatacagtgatgtggagcaaatctaaaaaatacctcccagttcggattgtagtctgcaactcgactacatgaagttggaatcgctagtaatcgtagatcagcaatgctacggtgaatacgttcccgggtcttgtactcaccgcccgtcacaccatgggagttgatttcactcgaagcggggatgctaagatagctaccctccacagtggaattagcgactggggtgaagtcgtaacaaggtaaccgtaggagaacctgcggttggatcacctcctttcaga

SEQ ID NO: 1469 - DNA, 1518 bp, Arcobacter molluscorum
  ref <308>: DATABASE ACCESSION NUMBER: NCBI ACCESSION: NZ_PDJX01000034.1
  ref <309>: DATABASE ENTRY DATE: 2019-04-01
  ref <313>: RELEVANT RESIDUES IN SEQ ID NO: (1)..(1518)
tttttggagagtttgatcctggctcagagtgaacgctggcggcgtgcttaacacatgcaagtcgaacgagaacggattatagcttgctataattgtcagctaagtggcgcacgggtgagtaatatataggtaatgtgccttcaagagggggataacagatggaaacgtctgctaagaccccatatgcctttaatacaaaagtatgcaagggaaatattaatagcttgaagatcggcctgtacagtatcagatagttggtgaggtaatggctcaccaagtcaatgacgcttaactggtttgagaggatgatcagtcacactggaactgagacacggtccagactcctacgggaggcagcagtggggaatattgcacaatgggggaaaccctgatgcagcaacgccgcgtggaggatgacacatttcggtgcgtaaactccttttatataggaagataatgacggtactatatgaataagcgccggctaactccgtgccagcagccgcggtaatacggagggcgcaagcgttactcggaatcactgggcgtaaagagcgtgtaggcggataaataagtcaggagtgaaatccaatagctcaactattgaactgcttttgaaactgtttatctagagtatgggagaggtagatggaatttctggtgtaggggtaaaatccgtagagatcagaaggaataccgattgcgaaggcgatctactggaacataactgacgctgagacgcgaaagcgtggggagcaaacaggattagataccctggtagtccacgccctaaacgatgtacactagttgttgctatgctcgacatagcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggtcttgacatagtaagaacattccagagatgggatggtgtctgcttgcagaaacttatatacaggtgctgcacggctgtcgtcagctcgtgtcgtgagatgttgggttaagtcccgcaacgagcgcaaccctcgtcattagttgctaacactacgggtgagaactctaatgagactgcctacgcaagtaggaggaaggtgaggacgacgtcaagtcatcatggcccttacgaccagggctacacacgtgctacaatggggtatacaaagagcagcgatacggtgacgtggagcaaatctaaaaaatatctctcagttcggattgtagtctgcaactcgactacatgaagttggaatcgctagtaatcgtagatcagcaatgctacggtgaatacgttcccgggtcttgtactcaccgcccgtcacaccatgggagttgatttcactcgaagcagggatgttaagataactaccttccacagtggaattagcgactggggtgaagtcgtaacaaggtaaccgtaggagaacctgcggttggatcacctcctttc

SEQ ID NO: 1470 - DNA, 661 bp, Arcobacter mytili
  ref <308>: DATABASE ACCESSION NUMBER: NCBI ACCESSION: NZ_NXID01000026.1
  ref <309>: DATABASE ENTRY DATE: 2019-04-01
  ref <313>: RELEVANT RESIDUES IN SEQ ID NO: (1)..(661)
tttttggagagtttgatcctggctcagagtgaacgctggcggcgtgcttaacacatgcaagtcgaacgagaacgggatatagcttgctatatttgtcagctaagtggcgcacgggtgagtaatgtataggtaacatgccctttacaaggaaataacagttggaaacgactgctaatgtcctatatgcctttaatactaaagtatgcaagggaaagatttatcggtaaaggattggcctgtattgtatcagttagttggtggggtaatggcctaccaagacaatgacgcataactggtttgagaggatgatcagtcacactggaactgagacacggtccagactcctacgggaggcagcagtggggaatattgcacaatggggggaaccctgatgcagcaacgccgcgtggaggatgacacatttcggtgcgtaaactccttttatataggaagataatgacggtactatatgaataagcgccggctaactccgtgccagcagccgcggtaatacggagggcgcaagcgttactcggaatcactgggcgtaaagagcgtgtaggcggatcgataagtcaggagtgaaatcctatggctcaaccatagaactgctcttgaaactgtcaatctagagtatgggagaggtagatggaatttctgg

SEQ ID NO: 1471 - DNA, 1518 bp, Arcobacter pacificus
  ref <308>: DATABASE ACCESSION NUMBER: NCBI ACCESSION: NZ_CP035928.1
  ref <309>: DATABASE ENTRY DATE: 2019-04-01
  ref <313>: RELEVANT RESIDUES IN SEQ ID NO: (1)..(1518)
tttatggagagtttgatcctggctcagagtgaacgctggcggcgtgcttaacacatgcaagtcgaacgagaacgggtattagcttgctaatactgtcagctaagtggcgaacgggtgagtaatatataggtaatgtgccttgaagaaggggataacagttggaaacgactgctaagaccctatatgcctttaaaacaaaagtttgcaagggaaatatttatagcttcaagatcggcctgtacagtatcagttagttggtgaggtaatggctcaccaagacaatgacgcttaactggtttgagaggatgatcagtcacactggaactgagacacggtccagactcctacgggaggcagcagtggggaatattgcacaatgggggaaaccctgatgcagcaacgccgcgtggaggatgacacatttcggtgcgtaaactccttttatataggaagataatgacggtactatatgaataagcgccggctaactccgtgccagcagccgcggtaatacggagggcgcaagcgttactcggaatcactgggcgtaaagagcgtgtaggcggatagataagttgggagtgaaatcctatggctcaaccatagaactgcttccaaaactgtctatctagagtatgggagaggtagatggaatttctggtgtaggggtaaaatccgtagagatcagaaggaataccgattgcgaaggcgatctactggaacattactgacgctgagacgcgaaagcgtggggagcaaacaggattagataccctggtagtccacgccctaaacgatgtacactagttgttgtgaggctagaccttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggtcttgacatagtaagaactttccagagatggattggtgtctgcttgcagaaacttatatacaggtgctgcacggctgtcgtcagctcgtgtcgtgagatgttgggttaagtcccgcaacgagcgcaaccctcgtcgttagttgctaacagttcggctgagaactctaacgagactgcctacgcaagtaggaggaaggtgaggacgacgtcaagtcatcatggcccttacgaccagggctacacacgtgctacaatggggtatacaaagagcagcgatacggtgacgtggagcaaatctcaaaaatatctcccagttcggatagtagtctgcaactcgactacttgaagttggaatcgctagtaatcgtagatcagctatgctacggtgaatacgttcccgggtcttgtactcaccgcccgtcacaccatgggagttgaactcattcgaagcagggatgctaaagtagctaccttccacagtggattcagcgactggggtgaagtcgtaacaaggtaaccgtaggagaacctgcggttggatcacctcctttc

SEQ ID NO: 1472 - DNA, 1519 bp, Arcobacter skirrowii
  ref <308>: DATABASE ACCESSION NUMBER: NCBI ACCESSION: NZ_UIGC01000002.1
  ref <309>: DATABASE ENTRY DATE: 2019-04-01
  ref <313>: RELEVANT RESIDUES IN SEQ ID NO: (1)..(1519)
attatggagagtttgatcctggctcagagtgaacgctggcggcgtgcttaacacatgcaagtcgaacgagaacgggctatagcttgctatagttgtcagctaagtggcgcacgggtgagtaatgtataggtaatatgcctcttactaagggataacaaatggaaacgtttgctaataccttatactccttttaaacaaaagtttaaaagggaaagatttattggtaagagattagcctgtattgtatcagttagttggtggggtaatggcttaccaagactatgacacataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataagaagataatgacggtattatatgaataagcaccggctaactccgtgccagcagccgcggtaatacggggggtgcaagcgttactcggaatcactgggcgtaaagagcatgtaggcggattaataagtttgaagtgaaatcctatagcttaactatagaactgctttgaaaactgttgatctagaatgtgggagaggtagatggaatttctggtgtaggggtaaaatccgtagagatcagaaggaataccgattgcgaaggcgatttactggaacacaattgacgctgagatgcgaaagcgtggggagcaaacaggattagataccctggtagtccacgccctaaacgatgtacactagttgttgtgagactagatcttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtgtttagttgctaacagttcggctgagaactctaaacagactgcctacgcaagtaggaggaaggtgaggacgacgtcaagtcatcatggcccttacgtccagggctacacacgtgctacaatgggatatacaaagagcggcaatacggtgacgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagtcgaactcattcgaagcggggatgctaaagtagctaccttccacagtggatttggcgactggggtgaagtcgtaacaaggtaaccgtaggagaacctgcggttggatcacctcctttc

SEQ ID NO: 1473 - DNA, 1517 bp, Arcobacter sp. CECT 8983
  ref <308>: DATABASE ACCESSION NUMBER: NCBI ACCESSION: NZ_PDKF01000006.1
  ref <309>: DATABASE ENTRY DATE: 2019-04-01
  ref <313>: RELEVANT RESIDUES IN SEQ ID NO: (1)..(1517)
tttatggagagtttgatcctggctcagagtgaacgctggcggcgtgcctaacacatgcaagtcgaacgagaacgggtttagtttactaaactgtcagctaagtggcgcacgggtgagtaatgtatagttaacctgccctctagaaaggaataacagttggaaacgactgctaatgccctatatgcccttaatacataagtatgcaggggaaacgctttagtgctagaggatgggactgtatggtatcagatagttggtgaggtaatggctcaccaagtcaatgacgcctaactggtttgagaggatgatcagtcacactggaactgagacacggtccagactcctacgggaggcagcagtggggaatattgcacaatggaggaaactctgatgcagcaacgccgcgtggaggatgacacttttcggagcgtaaactccttttatataggaagataatgacggtactatatgaataagcaccggctaactccgtgccagcagccgcggtaatacggagggtgcaagcgttactcggaatcactgggcgtaaagagcgtgtaggcgggttattaagtcagaagtgaaatcctatggctcaaccatagaactgcttttgaaactggtaacctagagtatgggagaggtagatggaatttctggtgtaggggtaaaatccgtagagatcagaaggaataccgattgcgaaggcgatctactggaacattactgacgctgagacgcgaaagcgtggggagcaaacaggattagataccctggtagtccacgccctaaacgatgtacactagttgttgccatgctagacatggcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggacttgacatttacagaactttcaagagattgattggtgtctgcttgcagaaactgtaggacaggtgctgcacggctgtcgtcagctcgtgtcgtgagatgttgggttaagtcccgcaacgagcgcaacccacgtcgttagttgctaacagttcggctgagaactctaacgagactgcctgggcaaccaggaggaaggtgtggacgacgtcaagtcatcatggcccttacgtccagggctacacacgtgctacaatggggtatacaaagagccgcgataccgcgaggtggagcaaatctcaaaaatatctcccagttcggattgtactctgcaactcgagtgcatgaagttggaatcgctagtaatcgtagatcagcaatgctacggtgaatacgttcccgggtcttgtactcaccgcccgtcacaccatgggagttgaactcattcgaagcggggatgctaaagtagctaccctccacagtggattcagcgactggggtgaagtcgtaacaaggtaaccgtaggtgaacctgcggttggatcacctcctttc

SEQ ID NO: 1474 - DNA, 1521 bp, Arcobacter sp. CECT 8985
  ref <308>: DATABASE ACCESSION NUMBER: NCBI ACCESSION: NZ_PDKC01000069.1
  ref <309>: DATABASE ENTRY DATE: 2019-04-01
  ref <313>: RELEVANT RESIDUES IN SEQ ID NO: (1)..(1521)
tttttggagagtttgatcctggctcagagtgaacgctggcggcgtgcttaacacatgcaagtcgaacgagaacggattatagcttgctataattgtcagctaagtggcgcacgggtgagtaatatataggtaatgtgccttcaagagggggataacagatggaaacgtctgctaagaccccatatgcctttaatacagaagtatgcaagggaaatatttatagcttgaagatcggcctgtacagtatcagatagttggtgaggtaatggctcaccaagtcaatgacgcttaactggtttgagaggatgatcagtcacactggaactgagacacggtccagactcctacgggaggcagcagtggggaatattgcacaatgggggaaaccctgatgcagcaacgccgcgtggaggatgacacatttcggtgcgtaaactccttttatataggaagataatgacggtactatatgaataagcgccggctaactccgtgccagcagccgcggtaatacggagggcgcaagcgttactcggaatcactgggcgtaaagagcgtgtaggcggataaataagtcagaagtgaaatccaatagctcaactattgaactgcttttgaaactgtttatctagagtatgggagaggtagatggaatttctggtgtaggggtaaaatccgtagagatcagaaggaataccgattgcgaaggcgatctactggaacataactgacgctgagacgcgaaagcgtggggagcaaacaggattagataccctggtagtccacgccctaaacgatgtacactagttgttgctatgctcgacatagcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggtcttgacatagtaagaagtctttagagataaagatgtgtctgcttgcagaagcttatatacaggtgctgcacggctgtcgtcagctcgtgtcgtgagatgttgggttaagtcccgcaacgagcgcaaccctcgtcattagttgctaacagttcggctgagaactctaatgagactgcctacgcaagtaggaggaaggtgaggacgacgtcaagtcatcatggcccttacgaccagggctacacacgtgctacaatggggtatacaaagagcagcgatacggtgacgtggagcaaatctaaaaaatatctcccagttcggatagtagtctgcaactcgactacttgaagttggaatcgctagtaatcgtagatcagcaatgctacggtgaatacgttcccgggtcttgtactcaccgcccgtcacaccatgggagttgatttcactcgaagcagggatgttaaaataactaccttccacagtggaattagcgactggggtgaagtcgtaacaaggtaaccgtaggagaacctgcggttggatcacctcctttcaga

SEQ ID NO: 1475 - DNA, 1521 bp, Arcobacter sp. CECT 8986
  ref <308>: DATABASE ACCESSION NUMBER: NCBI ACCESSION: NZ_PDKG01000019.1
  ref <309>: DATABASE ENTRY DATE: 2019-04-01
  ref <313>: RELEVANT RESIDUES IN SEQ ID NO: (1)..(1521)
tttttggagagtttgatcctggctcagagtgaacgctggcggcgtgcttaacacatgcaagtcgaacgagaacggattatagcttgctataattgtcagctaagtggcgcacgggtgagtaatatataggtaacgtgccttcaagaaggggataacagatggaaacgcctgctaacaccctatatgcctttaatacaaaagtatgcaagggaaatatttatagcttgaagatcggcctgtacagtatcagttagttggtgaggtaatggctcaccaagacaatgacgcttaactggtttgagaggatgatcagtcacactggaactgagacacggtccagactcctacgggaggcagcagtggggaatattgcacaatgggggaaaccctgatgcagcaacgccgcgtggaggatgacacatttcggtgcgtaaactccttttatataggaagataatgacggtactatatgaataagcgccggctaactccgtgccagcagccgcggtaatacggagggcgcaagcgttactcggaatcactgggcgtaaagagcgtgtaggcggataaataagtcagaagtgaaatccaatagctcaactattgaactgcttttgaaactgtttatctagagtatgggagaggtagatggaatttctggtgtaggggtaaaatccgtagagatcagaaggaataccgattgcgaaggcgatctactggaacataactgacgctgagacgcgaaagcgtggggagcaaacaggattagataccctggtagtccacgccctaaacgatgtacactagttgttgctatgctcgacatagcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggtcttgacatagtaagaagtctttagagataaagatgtgtctgcttgcagaaacttatatacaggtgctgcacggctgtcgtcagctcgtgtcgtgagatgttgggttaagtcccgcaacgagcgcaaccctcgtcattagttgctaacacttcgggtgagaactctaatgagactgcctacgcaagtaggaggaaggtgaggacgacgtcaagtcatcatggcccttacgaccagggctacacacgtgctacaatggggtatacaaagagcagcgatacggtgacgtggagcaaatcttaaaaatatctctcagttcggattgtagtctgcaactcgactacatgaagttggaatcgctagtaatcgtagatcagcaatgctacggtgaatacgttcccgggtcttgtactcaccgcccgtcacaccatgggagttgatttcactcgaagcggggatgctaagatagctaccctccacagtggaattagcgactggggtgaagtcgtaacaaggtaaccgtaggagaacctgcggttggatcacctcctttcaga

SEQ ID NO: 1476 - DNA, 1518 bp, Arcobacter sp. CECT 8987
  ref <308>: DATABASE ACCESSION NUMBER: NCBI ACCESSION: NZ_PDKN01000016.1
  ref <309>: DATABASE ENTRY DATE: 2019-04-01
  ref <313>: RELEVANT RESIDUES IN SEQ ID NO: (1)..(1518)
tttttggagagtttgatcctggctcagagtgaacgctggcggcgtgcttaacacatgcaagtcgaacgagaacggattaaagcttgctttaattgtcagctaagtggcgcacgggtgagtaatatataggtaatgtgccctagagagggggataacagatggaaacgtctgctaagaccccatatgcctttaattcataagaatgcaagggaaatatttatagctctaggatcggcctgtacggtatcagttagttggtgaggtaatggctcaccaagacaatgacgcctaactggtttgagaggatgatcagtcacactggaactgagacacggtccagactcctacgggaggcagcagtggggaatattgcacaatgggggaaaccctgatgcagcaacgccgcgtggaggatgacacatttcggtgcgtaaactccttttataggtcaagataatgacggtagcctatgaataagcgccggctaactccgtgccagcagccgcggtaatacggagggcgcaagcgttactcggaatcactgggcgtaaagagcgtgtaggcggatagataagtcagaagtgaaatccaatagcttaactattgaactgcttttgaaactgtctatctagagtatgggagaggtagatggaatttctggtgtaggggtaaaatccgtagagatcagaaggaataccgattgcgaaggcgatctactggaacataactgacgctgagacgcgaaagcgtggggagcaaacaggattagataccctggtagtccacgccctaaacgatgcacactagttgttgccatgctagacatggcagtaatgcagttaacacattaagtgtgccgcctggggagtacggtcgcaagattaaaactcaaaggaatagacggggacccgcacaagcggtggagcatgtggtttaattcgacgatacgcgaagaaccttacctggtcttgacatagtaagaactttctagagatagattggtgctagcttgctagaacttacatacaggtgctgcacggctgtcgtcagctcgtgtcgtgagatgttgggttaagtcccgcaacgagcgcaaccctcgtgtctagttgctaacagttcggctgagaactctagacagactgcctacgcaagtaggaggaaggtgaggacgacgtcaagtcatcatggcccttacgaccagggctacacacgtgctacaatggggtatacaaagagcagcgatacggtgacgtggagcaaatctcaaaaatatctcccagttcggattgtagtctgcaactcgactacatgaagttggaatcgctagtaatcgtagatcagcaatgctacggtgaatacgttcccgggtcttgtactcaccgcccgtcacaccatgggagttgaattcattcgaagcggggatgctaaagtagctaccttccacagtggattcagcgactggggtgaagtcgtaacaaggtaaccgtaggagaacctgcggttggatcacctcctttc

SEQ ID NO: 1477 - DNA, 1517 bp, Arcobacter sp. CECT 8989
  ref <308>: DATABASE ACCESSION NUMBER: NCBI ACCESSION: NZ_PDKE01000022.1
  ref <309>: DATABASE ENTRY DATE: 2019-04-01
  ref <313>: RELEVANT RESIDUES IN SEQ ID NO: (1)..(1517)
tttatggagagtttgatcctggctcagagtgaacgctggcggcgtgcctaacacatgcaagtcgaacgagaacgggtttagtttactaaactgtcagctaagtggcgcacgggtgagtaatgtatagttaacctgccctctagaaaggaataacagttggaaacgactgctaatgccctatatgcccataatacaaaagtatgctggggaaacgctttagtgctagaggatgggactgtatggtatcagatagttggtgaggtaatggctcaccaagtcaatgacgcctaactggtttgagaggatgatcagtcacactggaactgagacacggtccagactcctacgggaggcagcagtggggaatattgcacaatggaggaaactctgatgcagcaacgccgcgtggaggatgacacttttcggagcgtaaactccttttatataggaagataatgacggtactatatgaataagcaccggctaactccgtgccagcagccgcggtaatacggagggtgcaagcgttactcggaatcactgggcgtaaagagcgtgtaggcgggttattaagtcagaagtgaaatcctatggctcaaccatagaactgcttttgaaactggtaacctagagtatgggagaggtagatggaatttctggtgtaggggtaaaatccgtagagatcagaaggaataccgattgcgaaggcgatctactggaacattactgacgctgagacgcgaaagcgtggggagcaaacaggattagataccctggtagtccacgccctaaacgatgtacactagttgttgccatgctagacatggcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggacttgacatttacagaactttcaagagattgattggtgtctgcttgcagaaactgtaggacaggtgctgcacggctgtcgtcagctcgtgtcgtgagatgttgggttaagtcccgcaacgagcgcaacccacgtcgttagttgctaacagttcggctgagaactctaacgagactgcctgggcaaccaggaggaaggtgtggacgacgtcaagtcatcatggcccttacgtccagggctacacacgtgctacaatggggtatacaaagagccgcgataccgcgaggtggagcaaatctcaaaaatatctcccagttcggattgtactctgcaactcgagtgcatgaagttggaatcgctagtaatcgtagatcagcaatgctacggtgaatacgttcccgggtcttgtactcaccgcccgtcacaccatgggagttgaactcattcgaagcggggatgctaagatagctaccctccacagtggattcagcgactggggtgaagtcgtaacaaggtaaccgtaggtgaacctgcggttggatcacctcctttc

SEQ ID NO: 1478 - DNA, 1519 bp, Arcobacter sp. CECT 9299
  ref <308>: DATABASE ACCESSION NUMBER: NCBI ACCESSION: NZ_PDKH01000010.1
  ref <309>: DATABASE ENTRY DATE: 2019-04-01
  ref <313>: RELEVANT RESIDUES IN SEQ ID NO: (1)..(1519)
attatggagagtttgatcctggctcagagtgaacgctggcggcgtgcttaacacatgcaagtcgaacgagaacgggctatagcttgctatagttgtcagctaagtggcgcacgggtgagtaatgtataggtaatatgcctcttactaagggataacaaatggaaacgtttgctaataccttatactccttttatgcataagtataaaagggaaagatttattggtaagagattagcttgtattgtatcagttagttggtggggtaatggcctaccaagactatgacacataactggtttgagaggatgatcagtcacactggaactgagacacggtccagactcctacgggaggcagcagtggggaatattgcacaatggacggaagtctgatgcagcaacgccgcgtggaggatgacacatttcggtgcgtaaactccttttatataagaagataatgacggtattatatgaataagcaccggctaactccgtgccagcagccgcggtaatacggggggtgcaagcgttactcggaatcactgggcgtaaagagcatgtaggcggattaataagtttgaagtgaaatcctatagcttaactatagaactgctttgaaaactgttgatctagaatgtgggagaggtagatggaatttctggtgtaggggtaaaatccgtagagatcagaaggaataccgattgcgaaggcgatttactggaacacaattgacgctgagatgcgaaagcgtggggagcaaacaggattagataccctggtagtccacgccctaaacgatgtacactagttgttgtgagactagatcttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtgtttagttgctaacagtttggctgagaactctaaacagactgcctacgcaagtaggaggaaggtgaggacgacgtcaagtcatcatggcccttacgtccagggctacacacgtgctacaatgggatatacaaagagccgcaatacggtgacgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagtcgaactcattcgaagcggggatgctaaagtagctaccttccacagtggatttggcgactggggtgaagtcgtaacaaggtaaccgtaggagaacctgcggttggatcacctcctttc

SEQ ID NO: 1479 - DNA, 1517 bp, Arcobacter sp. F155
  ref <308>: DATABASE ACCESSION NUMBER: NCBI ACCESSION: NZ_PDJU01000019.1
  ref <309>: DATABASE ENTRY DATE: 2019-04-01
  ref <313>: RELEVANT RESIDUES IN SEQ ID NO: (1)..(1517)
tttatggagagtttgatcctggctcagagtgaacgctggcggcgtgcctaacacatgcaagtcgaacgagaacgggtttagtttactaaactgtcagctaagtggcgcacgggtgagtaatgtatagttaacctgccctctagaaaggaataacagttggaaacgactgctaatgccctatatgcccataatacataagtatgctggggaaacgctttagtgctagaggatgggactgtatggtatcagatagttggtgaggtaatggctcaccaagtcaatgacgcctaactggtttgagaggatgatcagtcacactggaactgagacacggtccagactcctacgggaggcagcagtggggaatattgcacaatggaggaaactctgatgcagcaacgccgcgtggaggatgacacttttcggagcgtaaactccttttatataggaagataatgacggtactatatgaataagcaccggctaactccgtgccagcagccgcggtaatacggagggtgcaagcgttactcggaatcactgggcgtaaagagcgtgtaggcgggttattaagtcagaagtgaaatcctatggctcaaccatagaactgcttttgaaactggtaacctagagtatgggagaggtagatggaatttctggtgtaggggtaaaatccgtagagatcagaaggaataccgattgcgaaggcgatctactggaacattactgacgctgagacgcgaaagcgtggggagcaaacaggattagataccctggtagtccacgccctaaacgatgtacactagttgttgccatgctagacatggcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggacttgacatttacagaactttcaagagattgattggtgtctgcttgcagaaactgtaggacaggtgctgcacggctgtcgtcagctcgtgtcgtgagatgttgggttaagtcccgcaacgagcgcaacccacgtcgttagttgctaacagttcggctgagaactctaacgagactgcctgggcaaccaggaggaaggtgtggacgacgtcaagtcatcatggcccttacgtccagggctacacacgtgctacaatggggtatacaaagagccgcgataccgcgaggtggagcaaatctcaaaaatatctcccagttcggattgtactctgcaactcgagtgcatgaagttggaatcgctagtaatcgtagatcagcaatgctacggtgaatacgttcccgggtcttgtactcaccgcccgtcacaccatgggagttgaactcattcgaagcggggatgctaagatagctaccctccacagtggattcagcgactggggtgaagtcgtaacaaggtaaccgtaggtgaacctgcggttggatcacctcctttc

SEQ ID NO: 1480 - DNA, 1518 bp, Arcobacter sp. F2176
  ref <308>: DATABASE ACCESSION NUMBER: NCBI ACCESSION: NZ_PDJV01000039.1
  ref <309>: DATABASE ENTRY DATE: 2019-04-01
  ref <313>: RELEVANT RESIDUES IN SEQ ID NO: (1)..(1518)
tttatggagagtttgatcctggctcagagtgaacgctggcggcgtgcttaacacatgcaagtcgaacgagaacgggttaaagcttgctttaactgtcagctaagtggcgcacgggtgagtaatatataggtaacatgccctagagagggggataacagatggaaacgtctgctaacaccccatatgcctttaagacctaagtctgcaagggaaacatttatggctctaggattggcctgtacggtatcagttagttggtgaggtaatggctcaccaagacaatgacacctaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataggaagataatgacggtactatatgaataagcaccggctaactccgtgccagcagccgcggtaatacggagggtgcaagcgttactcggaattactgggcgtaaagagcgtgtaggcgggtaaataagttggaagtgaaatcctatggctcaaccatagaactgcttccaaaactgttaacctagaatgtgggagaggtagatggaatttctggtgtaggggtaaaatccgtagatatcagaaggaataccgattgcgaaggcgatctactggaacataattgacgctgagacgcgaaagcgtggggagcaaacaggattagataccctggtagtccacgccctaaacgatgtacactagttgttgtgaggctagaccttgcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggtcttgacatagaaagaactttccagagatggattggtgcctgcttgcaggagctttcatacaggtgctgcacggctgtcgtcagctcgtgtcgtgagatgttgggttaagtcccgcaacgagcgcaaccctcgtcgttagttgctaacagttcggctgagaactctaacgagactgcctacgcaagtaggaggaaggtgaggacgacgtcaagtcatcatggcccttacgaccagggctacacacgtgctacaatggggtatacaaagagcagcaatacggtgacgtggagcgaatctcaaaaatgcctcccagttcggattgtagtctgcaactcgactacatgaagttggaatcgctagtaatcgtagatcagctatgctacggtgaatacgttcccgggtcttgtactcaccgcccgtcacaccatgggagttgaattcattcgaagcggggatgctaaaatagctaccttccacagtggatttagcgactggggtgaagtcgtaacaaggtaaccgtaggagaacctgcggttggatcacctcctttc

SEQ ID NO: 1481 - DNA, 1519 bp, Arcobacter sp. L; identical to SEQ ID NO: 1462
  ref <308>: DATABASE ACCESSION NUMBER: NCBI ACCESSION: NC_017192.1
  ref <309>: DATABASE ENTRY DATE: 2019-04-01
  ref <313>: RELEVANT RESIDUES IN SEQ ID NO: (1)..(1519)

SEQ ID NO: 1482 - DNA, 1519 bp, Arcobacter sp. LMG 29976
  ref <308>: DATABASE ACCESSION NUMBER: NCBI ACCESSION: NZ_NXGC01000014.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacggattatagcttgctataattgtcagctaagtggcgcacgggtgagtaatgtataggtaatatgcctcttactaagggataacaattggaaacgattgctaataccttatactccttgttaacttaagttaataagggaaagatttattggtaagagattagcctgtattgtatcagttagttggtggggtaatggcctaccaagactatgacacataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatatgagaagataatgacggtattatatgaataagcaccggctaactccgtgccagcagccgcggtaatacggggggtgcaagcgttactcggaatcactgggcgtaaagagcatgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacattattgacgctgagatgcgaaagcgtggggagcaaacaggattagataccctggtagtccacgccctaaacgatgtacactagttgttgtgagacttgatcttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtgtttagttgctaacagttcggctgagaactctaaacagactgcctacgcaagtaggaggaaggtgaggacgacgtcaagtcatcatggcccttacgtccagggctacacacgtgctacaatgggatatacaaagagccgcaatacggtgacgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagtcgaactcattcgaagcggggatgctaaaatagctaccttccacagtggatttggcgactggggtgaagtcgtaacaaggtaaccgtaggagaacctgcggttggatcacctcctttc

SEQ ID NO: 1483 - DNA, 1518 bp, Arcobacter sp. PSE-93
  ref <308>: DATABASE ACCESSION NUMBER: NCBI ACCESSION: NZ_CP032363.1
  ref <309>: DATABASE ENTRY DATE: 2019-04-01
  ref <313>: RELEVANT RESIDUES IN SEQ ID NO: (1)..(1518)
tttatggagagtttgatcctggctcagagtgaacgctggcggcgtgcttaacacatgcaagtcgaacgagaacggattaaagcttgctttaattgtcagctaagtggcgcacgggtgagtaatatataggtaacgtgccttcaagaaggggataacaattggaaacgattgctaataccctatatgcctttaagtcttaagactgcaagggaaatatttatagcttgaagatcggcctgtacagtatcagttagttggtgaggtaatggctcaccaagacaatgacgcttaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataggaagataatgacggtactatatgaataagcaccggctaactccgtgccagcagccgcggtaatacggagggtgcaagcgttactcggaatcactgggcgtaaagagaatgtaggcggatagaaaagtcagaagtgaaatccaatagctcaactattgaactgcttttgaaactttctatctagaatatgggagaggtagatggaatttctggtgtaggggtaaaatccgtagagatcagaaggaataccgattgcgaaggcgatctactggaacattattgacgctgagattcgaaagcgtggggagcaaacaggattagataccctggtagtccacgccctaaacgatgtacactagttgttgtgaggctagaccttgcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggacttgacatagatagaatataacagagatgtattagtgctagcttgctagaactatcatacaggtgctgcacggctgtcgtcagctcgtgtcgtgagatgttgggttaagtcccgcaacgagcgcaaccctcgtcattagttgctagcagttcggctgagaactctaatgagactgcctgggtaaccaggaggaaggtgaggacgacgtcaagtcatcatggcccttacgtccagggctacacacgtgctacaatggggtatacaaagagcagcaataccgtgaggtggagcaaatctcaaaaatatctcccagttcggatagcagtctgcaactcgactgcttgaagttggaatcgctagtaatcgtagatcagcaatgctacggtgaatacgttcccgggtcttgtactcaccgcccgtcacaccatgggaattgaactcattcgaagcgggaatgctaaagtagctaccctccacagtggattcagtaactggggtgaagtcgtaacaaggtaaccgtaggagaacctgcggttggatcacctcctttc

SEQ ID NO: 1484 - DNA, 1518 bp, Arcobacter sp. RW43-9
  ref <308>: DATABASE ACCESSION NUMBER: NCBI ACCESSION: NZ_MUXF01000009.1
  ref <309>: DATABASE ENTRY DATE: 2019-04-01
  ref <313>: RELEVANT RESIDUES IN SEQ ID NO: (1)..(1518)
tttatggagagtttgatcctggctcagagtgaacgctggcggcgtgcttaacacatgcaagtcgaacgagaacggattatagcttgctataattgtcagctaagtggcgcacgggtgagtaatgtataggtaatatgcctcttactaagggataacaattggaaacgattgctaataccttatattcctttttatcaaaagataaaaagggaaagatttattggtaagagattagcctgtattgtatcagttagttggtggggtaatggcctaccaagacaatgacgcataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataagaagataatgacggtattatatgaataagcaccggctaactccgtgccagcagccgcggtaatacggagggtgcaagcgttactcggaatcactgggcgtaaagagcgtgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacaatattgacgctgagacgcgaaagcgtggggagcaaacaggattagataccctggtagtccacgccctaaacgatgtacactagttgttgtgaggctcgaccttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaatgatttagagatagattagtgtctgcttgcagaaacttgcatacaggtgctgcacggctgtcgtcagctcgtgtcgtgagatgttgggttaagtcccgcaacgagcgcaaccctcgtccttagttgctaacagttcggctgagaactctaaggagactgcctacgcaagtaggaggaaggtgaggatgacgtcaagtcatcatggcccttacgtccagggctacacacgtgctacaatggggtatacaaagagcagcaatacggtgacgtggagcaaatctcaaaaatgcctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaagtagctaccttccacagtggattcagcgactggggtgaagtcgtaacaaggtaaccgtaggagaacctgcggttggatcacctcctttc

SEQ ID NO: 1485 - DNA, 1518 bp, Arcobacter sp. SM1702
  ref <308>: DATABASE ACCESSION NUMBER: NCBI ACCESSION: NZ_RCWF01000027.1
  ref <309>: DATABASE ENTRY DATE: 2019-04-01
  ref <313>: RELEVANT RESIDUES IN SEQ ID NO: (1)..(1518)
tttatggagagtttgatcctggctcagagtgaacgctggcggcgtgcttaacacatgcaagtcgaacgagaacggattatagcttgctataattgtcagctaagtggcgcacgggtgagtaatatataggtaacatgccttcaagaaggggataacgtttggaaacggacgctaagaccctatatgcctttaagtctaaagactgcaagggaaatatttatagcttgaagattggcctgtacagtatcagttagttggtgaggtaatggctcaccaagacaatgacgcttaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataggaagataatgacggtactatatgaataagcaccggctaactccgtgccagcagccgcggtaatacggagggtgcaagcgttactcggaatcactgggcgtaaagagaatgtaggcggataaataagtcagaagtgaaatccaatagcttaactattgaactgcttttgaaactgttgatctagaatatgggagaggtagatggaatttctggtgtaggggtaaaatccgtagagatcagaaggaataccgattgcgaaggcgatctactggaacattattgacgctgagattcgaaagcgtggggagcaaacaggattagataccctggtagtccacgccctaaacgatgcacactagttgttgtgaggctagaccttgcagtaatgcagttaacacattaagtgtgccgcctggggagtacggtcgcaagattaaaactcaaaggaatagacggggacccgcacaagcggtggagcatgtggtttaattcgacgatacgcgaagaaccttacctggacttgacatagatagaatataacagagatgtaatagtgctagcttgctagaactatcatacaggtgctgcacggctgtcgtcagctcgtgtcgtgagatgttgggttaagtcccgcaacgagcgcaaccctcgtcattagttgctaacagttcggctgagaactctaatgagactgcctgggtaaccaggaggaaggtgaggacgacgtcaagtcatcatggcccttacgtccagggctacacacgtgctacaatggggtatacaaagagcagcaatacagtgatgtggagcaaatctcaaaaatatctcccagttcggatagtagtctgcaactcgactacttgaagttggaatcgctagtaatcgtagatcagcaatgctacggtgaatacgttcccgggtcttgtactcaccgcccgtcacaccatgggaattgaactcattcgaagcgggaatgctaaaatagctaccctccacagtggattcagtaactggggtgaagtcgtaacaaggtaaccgtaggagaacctgcggttggatcacctcctttc

SEQ ID NO: 1486 - DNA, 1519 bp, Arcobacter suis
  ref <308>: DATABASE ACCESSION NUMBER: NCBI ACCESSION: NZ_NREO01000030.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacggattatagcttgctataattgtcagctaagtggcgcacgggtgagtaatatatagataacctgccctcaagaaaggaataacagttggaaacgactgctaatgccctatatgcctttaatacataagtatgcaagggaaacgctttagtgcttgaggatgggtctgtatggtatcagcttgttggtgaggtaatggctcaccaaggctatgacgcctaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatatgggaagataatgacggtaccatatgaataagcaccggctaactccgtgccagcagccgcggtaatacggagggtgcaagcgttactcggaatcactgggcgtaaagagcgtgtaggcggatatataagtcagaagtgaaatccaatagcttaactattgaactgcttttgaaactgtatatctagaatgtgggagaggtagatggaatttctggtgtaggggtaaaatccgtagagatcagaaggaataccgattgcgaaggcgatctactggaacattattgacgctgagacgcgaaagcgtggggagcaaacaggattagataccctggtagtccacgccctaaacgatgcacactagttgttgtgaggctagaccttgcagtaatgcagttaacacattaagtgtgccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtcattagttgctaacagttcggctgagaactctaatgagactgcctacgcaagtaggaggaaggtgaggacgacgtcaagtcatcatggcccttacgtccagggctacacacgtgctacaatggggtatacaaagagccgcaatacagtgatgtggagcaaatctcaaaaatatctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaaatagctaccttccacagtggattcagcgactggggtgaagtcgtaacaaggtaaccgtaggagaacctgcggttggatcacctcctttc

SEQ ID NO: 1487 - DNA, 1519 bp, Arcobacter thereius
  ref <308>: DATABASE ACCESSION NUMBER: NCBI ACCESSION: NZ_CP035926.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacgggctatagcttgctatagttgtcagctaagtggcgcacgggtgagtaatgtataggtaatatgccttttactaagggataacagttggaaacgactgctaataccttatattcctaatatgcagaagtatattagggaaagatttatcggtaagagattggcctgtattgtatcagttagttggtggggtaatggcctaccaagactatgacgcataactggtttgagaggatgatcagtcacactggaactgagacacggtccagactcctacgggaggcagcagtggggaatattgcacaatggacggaagtctgatgcagcaacgccgcgtggaggatgacacatttcggtgcgtaaactccttttatataagaagataatgacggtattatatgaataagcaccggctaactccgtgccagcagccgcggtaatacggggggtgcaagcgttactcggaatcactgggcgtaaagagcatgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacactattgacgctgagatgcgaaagcgtggggagcaaacaggattagataccctggtagtccacgccctaaacgatgtacactagttgttgtgagacttgatcttgcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggacttgacatagtaagaactttcaagagattgattggtgtctgcttgcagaaacttatatacaggtgctgcacggctgtcgtcagctcgtgtcgtgagatgttgggttaagtcccgcaacgagcgcaaccctcgtgtttagttgctaacagtttggctgagaactctaaacagactgcctacgcaagtaggaggaaggtgaggacgacgtcaagtcatcatggcccttacgtccagggctacacacgtgctacaatgggatatacagtgagctgcgatacagtgatgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagtcgaactcattcgaagcggggatgctaaagtagctaccttccacagtggatttggcgactggggtgaagtcgtaacaaggtaaccgtaggagaacctgcggttggatcacctcctttc

SEQ ID NO: 1488 - DNA, 1519 bp, Arcobacter trophiarum
  ref <308>: DATABASE ACCESSION NUMBER: NCBI ACCESSION: NZ_PDKD01000028.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacgggttatagcttgctataattgtcagctaagtggcgcacgggtgagtaatgtataggtaatatgcctcttactaagggataacaaatggaaacgtttgctaataccttatattccttttatacagaagtataaaagggaaagatttattggtaagagattagcctgtattgtatcagttagttggtggggtaatggcttaccaagacaatgacacataactggtttgagaggatgatcagtcacactggaactgagacacggtccagactcctacgggaggcagcagtggggaatattgcacaatggacggaagtctgatgcagcaacgccgcgtggaggatgacacatttcggtgcgtaaactccttttatatgagaagataatgacggtattatatgaataagcaccggctaactccgtgccagcagccgcggtaatacggggggtgcaagcgttactcggaatcactgggcgtaaagagcatgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacactattgacgctgagatgcgaaagcgtggggagcaaacaggattagataccctggtagtccacgccctaaacgatgtacactagttgttgtgagacttgatcttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaactttcaagagattgattggtgtctgcttgcagaagcttatatacaggtgctgcacggctgtcgtcagctcgtgtcgtgagatgttgggttaagtcccgcaacgagcgcaaccctcgtgtttagttgctaacagttcggctgagaactctaaacagactgcctacgcaagtaggaggaaggtgaggacgacgtcaagtcatcatggcccttacgtccagggctacacacgtgctacaatggggtatacaaagagctgcaatacggtgacgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagtcgaactcattcgaagcggggatgctaaagtagctaccttccacagtggatttggcgactggggtgaagtcgtaacaaggtaaccgtaggagaacctgcggttggatcacctcctttc

SEQ ID NO: 1489 - DNA, 1518 bp, Arcobacter venerupis
  ref <308>: DATABASE ACCESSION NUMBER: NCBI ACCESSION: NZ_NREP01000021.1
  ref <309>: DATABASE ENTRY DATE: 2019-04-01
  ref <313>: RELEVANT RESIDUES IN SEQ ID NO: (1)..(1518)
tttatggagagtttgatcctggctcagagtgaacgctggcggcgtgcttaacacatgcaagtcgaacgagaacggattatagcttgctataattgtcagctaagtggcgcacgggtgagtaatatataggtaatgtgccctagagaagaggataacagttggaaacgactgctaagactctatatgcctttaagacagaagtctgcaagggaaatatttatagctctaggatcagcctgtacagtatcagctagttggtgaggtaatggctcaccaaggcaatgacgcttaactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatatgggaagataatgacggtaccatatgaataagcaccggctaactccgtgccagcagccgcggtaatacggagggtgcaagcgttactcggaatcactgggcgtaaagagcgtgtaggcggataaataagtcagaagtgaaatccaatagcttaactattgaactgcttttgaaactgtatatctagaatgtgggagaggtagatggaatttctggtgtaggggtaaaatccgtagagatcagaaggaataccgattgcgaaggcgatctactggaacattattgacgctgagacgcgaaagcgtggggagcaaacaggattagataccctggtagtccacgccctaaacgatgcacactagttgttgtgaggctagaccttgcagtaatgcagttaacacattaagtgtgccgcctggggagtacggtcgcaagattaaaactcaaaggaatagacggggacccgcacaagcggtggagcatgtggtttaattcgacgatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtcattagttgctaacagttcggctgagaactctaatgagactgcctacgcaagtaggaggaaggtgaggacgacgtcaagtcatcatggcccttacgtccagggctacacacgtgctacaatggggtatacaaagagccgcaatacggtgacgtggagcaaatctcaaaaatatctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaaatagctaccttccacagtggattcagcgactggggtgaagtcgtaacaaggtaaccgtaggagaacctgcggttggatcacctcctttc

SEQ ID NO: 1490 - DNA, 1526 bp, Arcticibacter eurypsychrophilus
  ref <308>: DATABASE ACCESSION NUMBER: NCBI ACCESSION: NZ_MDFN01000051.1
  ref <309>: DATABASE ENTRY DATE: 2019-04-01
  ref <313>: RELEVANT RESIDUES IN SEQ ID NO: (1)..(1526)
tacaatggagagtttgatcctggctcaggatgaacgctagcggcaggcctaatacatgcaagtcgaggggtatgggttgcttgcaacccagagaccggcgcacgggtgcgtaacgcgtatgcaacctaccttgatcagggggatagcccggagaaatccggattaacaccgcataacattgtgatatggcatcatattataatcaaatatttataggatcgagatgggcatgcgtgacattagttagttggtgaggtaacggctcaccaagacttcgatgtctaggggatctgagaggatgaccccccacactggtactgagacacggaccagactcctacgggaggcagcagtaaggaatattggtcaatgggcgcaagcctgaaccagccatgccgcgtgcaggaagacggccctacgggttgtaaactgcttttgtaccggaataaacctgctctcgtgagagcagctgaacgtacggtaagaataaggatcggctaactccgtgccagcagccgcggtaatacggaggatccaagcgttatccggatttattgggtttaaagggtgcgtaggcggctttttaagtcaggggtgaaaacttgcggctcaaccgtaagcttgcctttgatactgaggagcttgaatacacttgaggtaggcggaatgtgacaagtagcggtgaaatgcatagatatgtcacagaacaccaattgcgaaggcagcttactaaagtgagattgacgctgaggcacgaaagcgtggggatcaaacaggattagataccctggtagtccacgccctaaacgatgaatactcgatgttagcgatatacagttagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttactgaagttcccagagatgggagcgtccttcgggacaggaaactaggtgctgcatggctgtcgtcagctcgtgccgtgaggtgttgggttaagtcccgcaacgagcgcaacccctgtgaatagttgccagcacgttaaggtggggactctattcagactgcctgtgcaaacagtgaggaaggaggggacgacgtcaagtcatcatggcccttacgtccggggctacacacgtgctacaatggatggtacagagggctgctacctggtaacaggatgccaatctcataaagccattcacagttcggattgaggtctgcaactcgacctcatgaagttggattcgctagtaatcgcgtatcagcaatgacgcggtgaatacgttcccgggccttgtacacaccgcccgtcaagccatggaagctgggggtacctgaagtatgtaaccgcaaggagcgtcctagggtaaaaccggtaactggggctaagtcgtaacaaggtagccgtaccggaaggtgcggctggaatacctcctttctaga

SEQ ID NO: 1491 - DNA, 1524 bp, Arcticibacter pallidicorallinus
  ref <308>: DATABASE ACCESSION NUMBER: NCBI ACCESSION: NZ_PVTH01000018.1
  ref <309>: DATABASE ENTRY DATE: 2019-04-01
  ref <313>: RELEVANT RESIDUES IN SEQ ID NO: (1)..(1524)
tacaatggagagtttgatcctggctcaggatgaacgctagcggcaggcctaatacatgcaagtcgaggggtatgggttgcttgcaacccagagaccggcgcacgggtgcgtaacgcgtatgcaatctaccttaatcagggggatagcccggagaaatccggattaacaccgcataacattatattgtggcatcacagtataatcaaatatttataggattaagatgagcatgcgtgacattagttagttggtgaggtaacggctcaccaagaccacgatgtctaggggatctgagaggatgaccccccacactggtactgagacacggaccagactcctacgggaggcagcagtaaggaatattggtcaatgggcgcaagcctgaaccagccatgccgcgtgcaggaagacggccctatgggttgtaaactgcttttgtaccggaataaaccttctcttgcgagagaagctgaacgtacggtaagaataaggatcggctaactccgtgccagcagccgcggtaatacggaggatccaagcgttatccggatttattgggtttaaagggtgcgtaggcggctttttaagtcaggggtgaaaacttgcggctcaaccgtaagcttgcctttgatactgaggagcttgaatacacttgaggtaggcggaatgtgacaagtagcggtgaaatgcatagatatgtcacagaacaccaattgcgaaggcagcttactaaagtgtgattgacgctgaggcacgaaagcgtggggatcaaacaggattagataccctggtagtccacgccctaaacgatgaatactcgatgttagcgatatacagttagcgtctaagcgaaagcgttaagtattccacctggggagtacgcccgcaagggtgaaactcaaaggaattgacgggggcccgcacaagcggaggagcatgtggtttaattcgatgatacgcgaggaaccttacccgggcttgaaagttactgaagttctcagagatgagagcgtccttcgggacaggaaactaggtgctgcatggctgtcgtcagctcgtgccgtgaggtgttgggttaagtcccgcaacgagcgcaacccctgtgaatagttgccagcacgtaatggtggggactctattcagactgcctgtgcaaacagagaggaaggaggggacgacgtcaagtcatcatggcccttacgtccggggctacacacgtgctacaatggatggtacagagggctgctacctggtaacaggatgccaatctcttaaagccattcacagttcggattgaggtctgcaactcgacctcatgaagttggattcgctagtaatcgcgtatcagcaatgacgcggtgaatacgttcccgggccttgtacacaccgcccgtcaagccatggaagctgggggtacctgaagtatgtaaccgcaaggagcgtcctagggtaaaaccggtaactggggctaagtcgtaacaaggtagccgtaccggaaggtgcggctggaatacctcctttcta

SEQ ID NO: 1492 - DNA, 1433 bp, Arenibacter echinorum
  ref <308>: DATABASE ACCESSION NUMBER: NCBI ACCESSION: NZ_QLLN01000022.1
  ref <309>: DATABASE ENTRY DATE: 2019-04-01
  ref <313>: RELEVANT RESIDUES IN SEQ ID NO: (1)..(1433)
gccggcgaccggcgcacgggtgcgcaacgcgtatagaatctgccctgtactggggaatagcccagagaaatttggattaaggccccatggtatgtatttgtggcatcacatatacattaaaggctacggtacaggatgactatgcgtcccattagttagttggtaaggtaacggcttaccaaggcagcgatgggtaggggccctgagagggggatcccccacactggtactgagacacggaccagactcctacgggaggcagcagtgaggaatattggacaatgggcgggagcctgatccagccatgccgcgtgcaggaagacggtcctatggattgtaaactgcttttgtacgggaagaacaaggggcacgtgtgcccctctgacggtaccgtaagaataaggatcggctaactccgtgccagcagccgcggtaatacggaggatccgagcgttatccggaatcattgggtttaaagggtccgtaggcgggccattaagtcaggggtgaaagtctgcggctcaaccgtagaattgcccttgatactggtggtcttgagttatggtgaagtaactagaatatgtagtgtagcggtgaaatgcatagatattacatagaataccgattgcgaaggcaggttactaaccatatactgacgctgatggacgaaagcgtggggagcgaacaggattagataccctggtagtccacgccgtaaacgatggatactagctgtccggatgcaaatctgggcggccaagcgaaagtgataagtatcccacctggggagtacgtccgcaaggatgaaactcaaaggaattgacgggggcccgcacaagcggtggagcatgtggtttaattcgatgatacgcgaggaaccttaccagggcttaaatgtggtctgacagctttagagatagagtttccttcgggcagatcacaaggtgctgcatggttgtcgtcagctcgtgccgtgaggtgtcaggttaagtcctataacgagcgcaacccctgccgttagttgccagcatgtaaagatggggactctaacgggactgccggtgcaaaccgcgaggaaggtggggatgacgtcaaatcatcacggcccttacgtcctgggccacacacgtgctacaatggccggtacagagagcagccactgggcaaccaggagcgaatctataaaaccggtcacagttcggatcggggtctgcaactcgaccccgtgaagctggaatcgctagtaatcggatatcagccatgatccggtgaatacgttcccgggccttgtacacaccgcccgtcaagccatggaagccgggagtgcctgaagtccgtcaccgcaaggagcggcctagggcaagatcggtaactagggctaagtcgtaacaaggtagccgtaccggaaggtgcggctggaacacctcctttct

SEQ ID NO: 1493 - DNA, 1547 bp, Aromatoleum aromaticum
  ref <308>: DATABASE ACCESSION NUMBER: NCBI ACCESSION: NC_006513.1
  ref <309>: DATABASE ENTRY DATE: 2019-04-01
  ref <313>: RELEVANT RESIDUES IN SEQ ID NO: (1)..(1547)
gattgaacttaagagtttgatcctggctcagattgaacgctggcggcatgctttacacatgcaagtcgaacggcagcgggggcttcggcctgccggcgagtggcgaacgggtgagtaatgcatcggaacgtacccagtcgtgggggataactacgcgaaagcgtggctaataccgcatacgccctgagggggaaagcgggggaccttcgggcctcgcgcgattggagcggctgatgtcggattagctggttggtggggtaaaggcctaccaaggcgacgatccgtagctggtctgagaggatgatcagccacactgggactgagacacggcccagactcctacgggaggcagcagtggggaattttggacaatgggcgcaagcctgatccagccatgccgcgtgagtgaagaaggccttcgggttgtaaagctctttcagacggaaagaaatcgggcgggtgaatagcctgcctggatgacggtactgtcagaagaagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaactgcgcttgtgactgcacggctggagtacggcagaggggggtggaattccacgtgtagcagtgaaatgcgtagagatgtggaggaacaccgatggcgaaggcagccccctgggccgatactgacgctcatgcacgaaagcgtggggagcaaacaggattagataccctggtagtccacgccctaaacgatgtcgactagttgttcggtgcggtaacgcgctgagtaacgcagctaacgcgtgaagtcgaccgcctggggagtacggccgcaaggttaaaactcaaaggaattgacggggacccgcacaagcggtggatgatgtggattaattcgatgcaacgcgaaaaaccttacctacccttgacatgcctggaatcctgcagagatgcgggagtgccttcgggagccaggacacaggtgctgcatggctgtcgtcagctcgtgtcgtgagatgttgggttaagtcccgcaacgagcgcaacccttgtcgctaattgccatcattaggttgggcactttagcgagactgccggtgacaaaccggaggaaggtggggatgacgtcaagtcctcatggcccttatgggtagggcttcacacgtcatacaatggtcggtacagagggttgccaagccgcgaggtggagccaatcccacaaagccgatcgtagtccggatcgtagtctgcaactcgactacgtgaagtcggaatcgctagtaatcgcagatcagcatgctgcggtgaatacgttcccgggtcttgtacacaccgcccgtcacaccatgggagtgggtttcaccagaagtaggtagcttaacctttcggggagggcgcttaccacggtgagattcatgactggggtgaagtcgtaacaaggtagccgtatcggaaggtgcggctggatcacctcctttcaaga

SEQ ID NO: 1494 - DNA, 1490 bp, Arsenicitalea aurantiaca
  ref <308>: DATABASE ACCESSION NUMBER: NCBI ACCESSION: NZ_RZNJ01000011.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgaacgccctcttcggagggagtggcagacgggtgagtaacgcgtgggaacctacctgatactacggaataactgagggaaacttcagctaataccgtatacgccctacgggggaaagatttatcggtatcagatgggcccgcgtaagattagctagttggtgaggtaatggctcaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtggggaagataatgacggtacccacagaagaagccccggctaacttcgtgccagcagccgcggtaatacgaagggggctagcgttgttcggatttactgggcgtaaagcgcacgtaggcggaatgttaagtcgggggtgaaatcccggggctcaaccccggaactgccttcgatactggcaatctcgagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttggggggtttacccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatcccggtcgcgctttccagagatggattgcttcagttcggctggaccggtgacaggtgctgcatggctgtcgtcagctcgtgtcgtgagatgttgggttaagtcccgcaacgagcgcaaccctcgcccttagttgccatcattcagttgggcactctagggggactgccggtgataagccggaggaaggtggggatgacgtcaagtcatcatggcccttatgggctgggctacacacgtgctacaatggtggtgacagagggcagctaggcggcgacgtcgtgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaag

SEQ ID NO: 1495 - DNA, 1531 bp, Arthrobacter crystallopoietes
ttaacggagagtttgatcctggctcaggacgaacgctggcggcgtgcttaacacatgcaagtcgaacgatggtccggtgcttgcaccggggattagtggcgaacgggtgagtaacacgtgagtaacctgcccttgactctgggataagcctgggaaaccgggtctaataccggatacgacctttcaccgcatggtggttggtggaaagattttttggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggctcaaccccgggtctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgccgcagaaatgcggtttcccttcggggctggtttacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggaccggcgattgggactaagtcgtaacaaggtagccgtaccggaaggtgcggctggatcacctcctttctaagga

SEQ ID NO: 1496 - DNA, 1534 bp, Arthrobacter oryzae
  ref <308>: DATABASE ACCESSION NUMBER: NCBI ACCESSION: NZ_RBED01000105.1
  ref <309>: DATABASE ENTRY DATE: 2019-04-01
  ref <313>: RELEVANT RESIDUES IN SEQ ID NO: (1)..(1534)
tcaacggagagtttgatcctggctcaggatgaacgctggcggcgtgcttaacacatgcaagtcgaacgatgatctccagcttgctggggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgggctggaaacagtccttcccctttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagctgtcgaaggtgggactggcgattgggactaagtcgtaacaaggtagccgtaccggaaggtgcggctggatcacctcctttctaagga

SEQ ID NO: 1497 - DNA, 1533 bp, Arthrobacter pascens
tttgacggagagtttgatcctggctcaggatgaacgctggcggcgtgcttaacacatgcaagtcgaacgatgaagcccagcttgctgggtggattagtggcgaacgggtgagtaacacgtgagtaacctgcccttgactctgggataagcctgggaaactgggtctaataccggatatgacctttcaccgcatggtggggggtggaaagcttttgtggttttggatggactcgcggcctatcagcttgttggtggggtaatggcctaccaaggcgatgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagccgtgaggtgacggtacctgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggatcgctgcagaaatgtggtttcccttcggggctggttcacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccgttagggggggagccgtcgaaggtgggaccggcgattgggactaagtcgtaacaaggtagccgtaccggaaggtgcggctggatcacctcctttctaagga

SEQ ID NO: 1498 - DNA, 1080 bp, Arthrobacter sp. AG1021
  ref <308>: DATABASE ACCESSION NUMBER: NCBI ACCESSION: NZ_RBLB01000002.1
  ref <309>: DATABASE ENTRY DATE: 2019-04-01
  ref <313>: RELEVANT RESIDUES IN SEQ ID NO: (1)..(1080)
agtgacggtacctgcagaagaagcgccggctaactacgtgccagcagccgcggtaatacgtagggcgcaagcgttatccggatttattgggcgtaaagagctcgtaggcggtttgtcgcgtctatcgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttccagatcgcctcagagatggggtttcccttcggggctggttcacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccaccttgtgtggggggagtcgtcgaaggtgggactggcgattgggactaagtcgtaacaaggtagccgtaccggaaggtgcggctggatcacctcctttctaagga

SEQ ID NO: 1499 - DNA, 1534 bp, Arthrobacter sp. Bz4
  ref <308>: DATABASE ACCESSION NUMBER: NCBI ACCESSION: NZ_QDAE01000048.1
  ref <309>: DATABASE ENTRY DATE: 2019-04-01
  ref <313>: RELEVANT RESIDUES IN SEQ ID NO: (1)..(1534)
tttacggagagtttgatcctggctcaggatgaacgctggcggcgtgcttaacacatgcaagtcgaacgatgatcccagcttgctgggggattagtggcgaacgggtgagtaacacgtgagtaacctgcccttgactctgggataagcctgggaaaccgggtctaatactggatatgaccttctggcgcatgccatgttggtggaaagctttattgcggttttggatggactcgcggcctatcagcttgttggtggggtaatggcctaccaaggcgacgacgggtagccggcctgagagggtggacggccacactgggactgagacacggcccagactcctacgggaggcagcagtggggaatattgcacaatgggcgcaagcctgatgcagcgacgccgcgtgggggatgaaggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggcttaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaactggaacagcgcagagatgtgttggccgcttgcggccggtttacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcacgaaagttggtaacacccgaagccggtggcctaacccccttgtggggagggagctgtcgaaggtgggaccggcgattgggactaagtcgtaacaaggtagccgtaccggaaggtgcggctggatcacctcctttctaagga

SEQ ID NO: 1500 - DNA, 1537 bp, Arthrobacter sp. Hz2
  ref <308>: DATABASE ACCESSION NUMBER: NCBI ACCESSION: NZ_QZVT01000026.1
  ref <309>: DATABASE ENTRY DATE: 2019-04-01
  ref <313>: RELEVANT RESIDUES IN SEQ ID NO: (1)..(1537)
tttacggagagtttgatcctggctcaggatgaacgctggcggcgtgcttaacacatgcaagtcgaacgatgaacctcacttgtggggggattagtggcgaacgggtgagtaacacgtgagtaacctgcccttgactctgggataagcctgggaaaccgggtctaatactggatacgaccttctggcgcatgccatgttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgaaggccttcgggttgtaaacctctttcagtagggaagaagctggccttttgggttggtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggcttaactccggatctgcggtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaatgatgcagagatgtgtcagccacttgtggccggtttacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagttggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggaccggcgattgggactaagtcgtaacaaggtagccgtaccggaaggtgcggctggatcacctcctttcta

SEQ ID NO: 1501 - DNA, 1530 bp, Arthrobacter sp. JZ R-183
  ref <308>: DATABASE ACCESSION NUMBER: NCBI ACCESSION: NZ_QQXL01000012.1
  ref <309>: DATABASE ENTRY DATE: 2019-04-01
  ref <313>: RELEVANT RESIDUES IN SEQ ID NO: (1)..(1530)
tttgcggagagtttgatcctggctcaggatgaacgctggcggcgtgcttaacacatgcaagtcgaacgatgatctccagcttgctggggggattagtggcgaacgggtgagtaacacgtgagtaacctgcccctgactctgggataagcccgggaaactgggtctaatactggatattaccttctgccgcatggtggttggtggaaagatttttcggttggggatggactcgcggcctatcagcttgttggtgaggtagtggctcaccaaggcgacgacgggtagccggcctgagagggtggacggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgccgtgaaagtccggggcttaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggattagatcgccgcagagatgtggtttcccttcggggctggttcacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttttgggagggagccgtcgaaggtgggattggcgattgggactaagtcgtaacaaggtagccgtaccggaaggtgcggctggatcacctcctttctaagga

SEQ ID NO: 1502 - DNA, 1531 bp, Arthrobacter sp. JZ R-35
  ref <308>: DATABASE ACCESSION NUMBER: NCBI ACCESSION: NZ_QQXK01000050.1
  ref <309>: DATABASE ENTRY DATE: 2019-04-01
  ref <313>: RELEVANT RESIDUES IN SEQ ID NO: (1)..(1531)
tttgcggagagtttgatcctggctcaggatgaacgctggcggcgtgcttaacacatgcaagtcgaacgatgaccccgtgcttgcacgggtgatgagtggcgaacgggtgagtaacacgtgagtaacctgcccctgactctgggataagcccgggaaactgggtctaataccggatatgactgctggccgcatggcctggtggtggaaagaatttcggttggggatggactcgcggcctatcagcttgttggtgaggtagtggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccggggcttaaccccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggactggatcgccgcagagatgtggtttcccttcggggctggttcacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtgaggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcatgaaagttggtaacacccgaagccggtggcctaaccccttgtgggagggagccgtcgaaggtgggactggcgattaggactaagtcgtaacaaggtagccgtaccggaaggtgcggctggatcacctcctttctaagga

SEQ ID NO: 1503 - DNA, 1532 bp, Arthrobacter sp. LAM7117
  ref <308>: DATABASE ACCESSION NUMBER: NCBI ACCESSION: NZ_RJAE01000028.1
  ref <309>: DATABASE ENTRY DATE: 2019-04-01
  ref <313>: RELEVANT RESIDUES IN SEQ ID NO: (1)..(1532)
ttaacggagagtttgatcctggctcaggacgaacgctggcggcgtgcttaacacatgcaagtcgaacgatgatccggtgcttgcaccggggattagtggcgaacgggtgagtaacacgtgagtaacctgcccttgactctgggataagcctgggaaaccgggtctaataccggatatgacctgtcaccgcatggtggtgggtggaaagattttttggtcttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgaatgccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggctcaaccccgggtctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggaccgggctggaaacagtccttcccttcggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggaccggcgattgggactaagtcgtaacaaggtagccgtaccggaaggtgcggctggatcacctcctttctaaggag

SEQ ID NO: 1504 - DNA, 1538 bp, Arthrobacter sp. MDT2-14
  ref <308>: DATABASE ACCESSION NUMBER: NCBI ACCESSION: NZ_QZVU01000013.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggatgagaagagcttgctcttcgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 1505 - DNA, 1533 bp, Arthrobacter sp. NEAU-SA1
  ref <308>: DATABASE ACCESSION NUMBER: NCBI ACCESSION: NZ_QRCU01000009.1
  ref <309>: DATABASE ENTRY DATE: 2019-04-01
  ref <313>: RELEVANT RESIDUES IN SEQ ID NO: (1)..(1533)
tttgacggagagtttgatcctggctcaggatgaacgctggcggcgtgcttaacacatgcaagtcgaacgatgatgcaccgcttgcggtgtggattagtggcgaacgggtgagtaacacgtgagtaacctgcccttgactctgggataagcctgggaaactgggtctaataccggatatgacctttcaccgcatggtggggggtggaaagcttttgtggttttggatggactcgcggcctatcagcttgttggtggggtaatggcctaccaaggcgatgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagccgtgaggtgacggtacctgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgctgcagaaatgtggtttcccttcggggctggttcacaggtggtgcatggttgtcgtcagctcgtgtcgtgagatgttgggttaagtcccgcaacgagcgcaaccctcgttccatgttgccagcacgtgatggtggggactcatgggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccgtaagggggggagccgtcgaaggtgggaccggcgattgggactaagtcgtaacaaggtagccgtaccggaaggtgcggctggatcacctcctttctaagga

SEQ ID NO: 1506 - DNA, 1170 bp, Arthrobacter sp. NEAU-SA2
  ref <308>: DATABASE ACCESSION NUMBER: NCBI ACCESSION: NZ_QYLP01000008.1
  ref <309>: DATABASE ENTRY DATE: 2019-04-01
  ref <313>: RELEVANT RESIDUES IN SEQ ID NO: (1)..(1170)
tgcacaatgggcgcaagcctgatgcagcgacgccgcgtgagggatgacggccttcgggttgtaaacctctttcagtagggaagaagccgcaaggtgacggtacctgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgctctggaaacagggcttcccttcggggctggttcacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccctttttgggggggagccgtcgaaggtgggaccggcgattgggactaagtcgtaacaaggtagccgtaccggaaggtgcggctggatcacctcctttctaagga

SEQ ID NO: 1507 - DNA, 1531 bp, Arthrobacter sp. TB 26
  ref <308>: DATABASE ACCESSION NUMBER: NCBI ACCESSION: NZ_AUPJ01000254.1
  ref <309>: DATABASE ENTRY DATE: 2019-04-01
  ref <313>: RELEVANT RESIDUES IN SEQ ID NO: (1)..(1531)
tcaacggagagtttgatcctggctcaggatgaacgctggcggcgtgcttaacacatgcaagtcgaacgatgaacctcacttgtggggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaatacctggaaacaggtgccccgcttgcggtcggtttacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagctgtcgaaggtgggactggcgattgggactaagtcgtaacaaggtagccgtaccggaaggtgcggctggatcacctcctttctaagga

SEQ ID NO: 1508 - DNA, 1496 bp, Arthrospira maxima
  ref <308>: DATABASE ACCESSION NUMBER: NCBI ACCESSION: NZ_ABYK01000016.1
  ref <309>: DATABASE ENTRY DATE: 2019-04-01
  ref <313>: RELEVANT RESIDUES IN SEQ ID NO: (1)..(1496)
aacacggagagtttgatcctggctcaggatgaacgctggcggtctgcttaacacatgcaagtcgaacgggctcttcggagctagtggcggacgggtgagtaacacgtgagaatctggctcccggtcggggacaacagagggaaacttctgctaatcccggatgagccgaaaggtaaaagatttatcgccgggagatgagctcgcgtctgattagctagttggtgaggtaaaggctcaccaaggcgacgatcagtagctggtctgagaggatgatcagccacactgggactgagacacggcccagactcctacgggaggcagcagtggggaattttccgcaatgggcgcaagcctgacggagcaagaccgcgtgggggaggaaggctcttgggttgtaaaccccttttctcaaggaagaacacaatgacggtacttgaggaataagcctcggctaactccgtgccagcagccgcggtaatacggaggaggcaagcgttatccggaatgattgggcgtaaagcgtccgtaggtggctgttcaagtctgctgtcaaagacagtggcttaactactgaaaggcagtggaaactgaacagctagagtacggtaggggcagagggaattcccggtgtagcggtgaaatgcgtagatatcgggaagaacaccggtggcgaaagcgctctgctgggccgtaactgacactgagggacgaaagctaggggagcgaatgggattagataccccagtagtcctagccgtaaacgatggaaactaggtgtagcctgtatcgacccgggctgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaatcttggtgaaagccgagagtgccttcgggagccggaacacaggtggtgcatggctgtcgtcagctcgtgtcgtgagatgttgggttaagtcccgcaacgagcgcaaccctcgtccttagttgccatcattcagttgggcactttagggagactgccggtgacaaaccggaggaaggtggggatgacgtcaagtcatcatgccccttacgtcctgggctacacacgtactacaatgggggggacaaagggtagccaagacgcgagtctgagccaatcccgtaaacctctcctcagttcagattgcaggctgcaactcgcctgcatgaaggaggaatcgctagtaatcgcaggtcagcatactgcggtgaatccgttcccgggccttgtacacaccgcccgtcacaccatggaagttagccacgcccgaagtcgttactctaaccgttcgcggaggaggatgccgaaggcagggctgatgactggggtgaagtcgtaacaaggtagccgtaccggaaggtgtggctggatcacctcctttttaggga

SEQ ID NO: 1509 - DNA, 1493 bp, Arthrospira platensis
  ref <308>: DATABASE ACCESSION NUMBER: NCBI ACCESSION: NZ_CP013008.1
  ref <309>: DATABASE ENTRY DATE: 2019-04-01
  ref <313>: RELEVANT RESIDUES IN SEQ ID NO: (1)..(1493)
aacacggagagtttgatcctggctcaggatgaacgctggcggtctgcttaacacatgcaagtcgaacgggctcttcggagctagtggcggacgggtgagtaacacgtgagaatctggctcccggtcggggacaacagagggaaacttctgctaatcccggatgagccgaaaggtaaaagatttatcgccgggagatgagctcgcgtctgattagctagttggtgaggtaaaggctcaccaaggcgacgatcagtagctggtctgagaggatgatcagccacactgggactgagacacggcccagactcctacgggaggcagcagtggggaattttccgcaatgggcgcaagcctgacggagcaagaccgcgtgggggaggaaggctcttgggttgtaaaccccttttctcaaggaagaacacaatgacggtacttgaggaataagcctcggctaactccgtgccagcagccgcggtaatacggaggaggcaagcgttatccggaatgattgggcgtaaagcgtccgtaggtggcagttcaagtctgctgtcaaagacagtagctcaactactgaaaggcagtggaaactgaacagctagagtacggtaggggcagagggaattcccggtgtagcggtgaaatgcgtagatatcgggaagaacaccggtggcgaaagcgctctgctgggccgtaactgacactgagggacgaaagctaggggagcgaatgggattagataccccagtagtcctagccgtaaacgatggaaactaggtgtagcctgtatcgacccgggctgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaatcttggtgaaagccgagagtgccttcgggagccggaacacaggtggtgcatggctgtcgtcagctcgtgtcgtgagatgttgggttaagtcccgcaacgagcgcaaccctcgtccttagttgccatcattcagttgggcactttagggagactgccggtgacaaaccggaggaaggtggggatgacgtcaagtcatcatgccccttacgtcctgggctacacacgtactacaatgggggggacaaagggtagccaagacgcgagtctgagccaatcccgtaaacctctcctcagttcagattgcaggctgcaactcgcctgcatgaaggaggaatcgctagtaatcgcaggtcagcatactgcggtgaatccgttcccgggccttgtacacaccgcccgtcacaccatggaagttagccacgcccgaagtcgttactctaaccgttcgcggaggaggatgccgaaggcagggctgatgactggggtgaagtcgtaacaaggtagccgtaccggaaggtgtggctggatcacctcctttttag

SEQ ID NO: 1510 - DNA, 1493 bp, Arthrospira sp. O9.13F
  ref <308>: DATABASE ACCESSION NUMBER: NCBI ACCESSION: NZ_PKGD01000034.1
  ref <309>: DATABASE ENTRY DATE: 2019-04-01
  ref <313>: RELEVANT RESIDUES IN SEQ ID NO: (1)..(1493)
aacacggagagtttgatcctggctcaggatgaacgctggcggtctgcttaacacatgcaagtcgaacgggctcttcggagctagtggcggacgggtgagtaacacgtgagaatctggctcccggtcggggacaacagagggaaacttctgctaatcccggatgagccgaaaggtaaaagatttatcgccgggagatgagctcgcgtctgattagctagttggtgaggtaaaggctcaccaaggcgacgatcagtagctggtctgagaggatgatcagccacactgggactgagacacggcccagactcctacgggaggcagcagtggggaattttccgcaatgggcgcaagcctgacggagcaagaccgcgtgggggaggaaggctcttgggttgtaaaccccttttctcaaggaagaacacaatgacggtacttgaggaataagcctcggctaactccgtgccagcagccgcggtaatacggaggaggcaagcgttatccggaatgattgggcgtaaagcgtccgtaggtggctgttcaagtctgctgtcaaagacagtggcttaactactgaaaggcagtggaaactgaacagctagagtgcggtaggggcagagggaattcccggtgtagcggtgaaatgcgtagatatcgggaagaacaccggtggcgaaagcgctctgctgggccgcaactgacactgagggacgaaagctaggggagcgaatgggattagataccccagtagtcctagccgtaaacgatggaaactaggtgtagcctgtatcgacccgggctgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaatcttggtgaaagccgagagtgccttcgggagccggaacacaggtggtgcatggctgtcgtcagctcgtgtcgtgagatgttgggttaagtcccgcaacgagcgcaaccctcgtccttagttgccatcattcagttgggcactttagggagactgccggtgacaaaccggaggaaggtggggatgacgtcaagtcatcatgccccttacgtcctgggctacacacgtactacaatgggggggacaaagggtagccaagacgcgagtctgagccaatcccgtaaacctctcctcagttcagattgcaggctgcaactcgcctgcatgaaggaggaatcgctagtaatcgcaggtcagcatactgcggtgaatccgttcccgggccttgtacacaccgcccgtcacaccatggaagttagccacgcccgaagtcgttactctaaccgttcgcggaggaggatgccgaaggcagggctgatgactggggtgaagtcgtaacaaggtagccgtaccggaaggtgtggctggatcacctcctttttag

SEQ ID NO: 1511 - DNA, 1496 bp, Arthrospira sp. PCC 8005; identical to SEQ ID NO: 1508
  ref <308>: DATABASE ACCESSION NUMBER: NCBI ACCESSION: NZ_FO818640.1
  ref <309>: DATABASE ENTRY DATE: 2019-04-01
  ref <313>: RELEVANT RESIDUES IN SEQ ID NO: (1)..(1496)

SEQ ID NO: 1512 - DNA, 1496 bp, Arthrospira sp. TJSD091; identical to SEQ ID NO: 1508
  ref <308>: DATABASE ACCESSION NUMBER: NCBI ACCESSION: NZ_LAYT01000292.1
  ref <309>: DATABASE ENTRY DATE: 2019-04-01
  ref <313>: RELEVANT RESIDUES IN SEQ ID NO: (1)..(1496)

SEQ ID NO: 1513 - DNA, 1493 bp, Arthrospira sp. TJSD092
  ref <308>: DATABASE ACCESSION NUMBER: NCBI ACCESSION: NZ_CP028914.1
  ref <309>: DATABASE ENTRY DATE: 2019-04-01
  ref <313>: RELEVANT RESIDUES IN SEQ ID NO: (1)..(1493)
aacacggagagtttgatcctggctcaggatgaacgctggcggtctgcttaacacatgcaagtcgaacgggctcttcggagctagtggcggacgggtgagtaacacgtgagaatctggctcccggtcggggacaacagagggaaacttctgctaatcccggatgagccgaaaggtaaaagatttatcgccgggagatgagctcgcgtctgattagctagttggtgaggtaaaggctcaccaaggcgacgatcagtagctggtctgagaggatgatcagccacactgggactgagacacggcccagactcctacgggaggcagcagtggggaattttccgcaatgggcgcaagcctgacggagcaagaccgcgtgggggaggaaggctcttgggttgtaaaccccttttctcaaggaagaacacaatgacggtacttgaggaataagcctcggctaactccgtgccagcagccgcggtaatacggaggaggcaagcgttatccggaatgattgggcgtaaagcgtccgtaggtggctgttcaagtctgctgtcaaagacagtggcttaactactgaaaggcagtggaaactgaacagctagagtacggtaggggcagagggaattcccggtgtagcggtgaaatgcgtagatatcgggaagaacaccggtggcgaaagcgctctgctgggccgtaactgacactgagggacgaaagctaggggagcgaatgggattagataccccagtagtcctagccgtaaacgatggaaactaggtgtagcctgtatcgacccgggctgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaatcttggtgaaagccgagagtgccttcgggagccggaacacaggtggtgcatggctgtcgtcagctcgtgtcgtgagatgttgggttaagtcccgcaacgagcgcaaccctcgtccttagttgccatcattcagttgggcactttagggagactgccggtgacaaaccggaggaaggtggggatgacgtcaagtcatcatgccccttacgtcctgggctacacacgtactacaatgggggggacaaagggtagccaagacgcgagtctgagccaatcccgtaaacctctcctcagttcagattgcaggctgcaactcgcctgcatgaaggaggaatcgctagtaatcgcaggtcagcatactgcggtgaatccgttcccgggccttgtacacaccgcccgtcacaccatggaagttagccacgcccgaagtcgttactctaaccgttcgcggaggaggatgccgaaggcagggctgatgactggggtgaagtcgtaacaaggtagccgtaccggaaggtgtggctggatcacctcctttttag

SEQ ID NO: 1514 - DNA, 1302 bp, Asaccharobacter celatus
  ref <308>: DATABASE ACCESSION NUMBER: NCBI ACCESSION: NZ_QICA01000044.1
  ref <309>: DATABASE ENTRY DATE: 2019-04-01
  ref <313>: RELEVANT RESIDUES IN SEQ ID NO: (1)..(1302)
acggcgcgggatggggtcgcggcccattaggtagacggcggggtaacggcccaccgtgcccgcgatgggtagccggactgagaggtcgaccggccacattgggactgagatacggcccagactcctacgggaggcagcagtggggaattttgcgcaatggggggaaccctgacgcagcaacgccgcgtgcgggacgaaggccttcgggttgtaaaccgctttcagcagggaagacatagacggtacctgcagaagaagctccggctaactacgtgccagcagccgcggtaatacgtagggggcgagcgttatccggattcattgggcgtaaagcgcgcgtaggcggccgcctaagcggaacctctaatcccggggctcaacctcgggccgggttccggactgggcggctcgagtgcggtagaggcaggcggaattcccggtgtagcggtggaatgcgcagatatcgggaagaacaccgatggcgaaggcagcctgctgggccgccactgacgctgaggcgcgaaagctgggggagcgaacaggattagataccctggtagtcccagccgtaaacgatggacgctaggtgtggggggaccatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcgagtgaagccgcggagacgcggtggccgagaggagctcgcgcaggtggtgcatggctgtcgtcagctcgtgtcgtgagatgttgggttaagtcccgcaacgagcgcaacccccgtcccgtgttgccagcattcagttggggactcgcgggagactgccggcgtcaagccggaggaaggtggggacgacgtcaagtcatcatgccccttatgccctgggctgcacacgtgctacaatggccggtacagagggttgccaccccgcgagggggagcggatcccggaaagccggtcccagttcggatcgcaggctgcaacccgcctgcgtgaagtcggagttgctagtaatcgcggatcagcatgccgcggtgaatacgttcccgggccttgtacacaccgcccgtcacaccacccgagtcgtctgcacccgaagccgccggccgaacccttctggggcggaggcgtcgaaggtgtggagggtaaggggggtgaagtcgtaacaaggtagccgtaccggaaggtgcggctggatcacctcctttctagggag

SEQ ID NO: 1515 - DNA, 1493 bp, Asaia astilbis
  ref <308>: DATABASE ACCESSION NUMBER: NCBI ACCESSION: NZ_BAJT01000033.1
  ref <309>: DATABASE ENTRY DATE: 2019-04-01
  ref <313>: RELEVANT RESIDUES IN SEQ ID NO: (1)..(1493)
tgaacctgagagtttgatcctggctcagagcgaacgctggcggcatgcttaacacatgcaagtcgcacggactcttcggagtgagtggcggacgggtgagtatcgcgtagggatctatccacgggtgggggataacactgggaaactggtgctaataccgcatgatacctgagggtcaaaggcgcaagtcgcctgtggaggagcctgcgttcgattagcttgttggtggggtaaaggcctaccaaggcgatgatcgatagctggtctgagaggatgatcagcacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgcacagtcagatgtgaaattccagggcttaaccttggggctgcatttgatacgtgtagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccaggacttgacatggggaggctgtatccagagatgggtatttcccgcaagggacctcctgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgtcctgggctacacacgtgctacaatggcggtgacagtgggaagctagatggtgacatcatgccgatctctaaaagccgtctcagttcggattgtactctgcaactcgagtacatgaaggtggaatcgctagtaatcgcggatcagcatgccgcggtgaatacgttcccgggccttgtacacaccgcccgtcacaccatgggagttggtttgacccgaagccggtgagcgaaccgcaaggacgcagccgaccacggtcgggtcagcgactggggtgaagtcgtaacaaggtagccgtaggggaacctgcggctggatcacctcctttcaag

SEQ ID NO: 1516 - DNA, 1494 bp, Asaia bogorensis
  ref <308>: DATABASE ACCESSION NUMBER: NCBI ACCESSION: NZ_UEGO01000042.1
  ref <309>: DATABASE ENTRY DATE: 2019-04-01
  ref <313>: RELEVANT RESIDUES IN SEQ ID NO: (1)..(1494)
tgaacctgagagtttgatcctggctcagagcgaacgctggcggcatgcttaacacatgcaagtcgcacggacccttcggggtgagtggcggacgggtgagtatcgcgtagggatctatccacgggtgggggataacatcgggaaactggtgctaataccgcatgatacctgagggtcaaaggcgcaagtcgcctgtggaggagcctgcgttcgattagcttgttggtggggtaaaggcctaccaaggcgatgatcgatagctggtctgagaggatgatcagccacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttacacagtcagatgtgaaattccagggcttaaccttggggctgcatttgatacgtgtagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgacatggggaggctgtatccagagatgggtatttcccgcaagggacctcctgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgtcctgggctacacacgtgctacaatggcggtgacagtgggaagctagatggtgacatcgtgccgatctctaaaagccgtctcagttcggattgtactctgcaactcgagtgcatgaaggtggaatcgctagtaatcgcggatcagcatgccgcggtgaatacgttcccgggccttgtacacaccgcccgtcacaccatgggagttggtttgacccgaagccggtgagcgaaccgcaaggacgcagccgaccacggtcgggtcagcgactggggtgaagtcgtaacaaggtagccgtaggggaacctgcggctggatcacctcctttcaag

SEQ ID NO: 1517 - DNA, 1494 bp, Asaia platycodi
  ref <308>: DATABASE ACCESSION NUMBER: NCBI ACCESSION: NZ_CBLX010000024.1
  ref <309>: DATABASE ENTRY DATE: 2019-04-01
  ref <313>: RELEVANT RESIDUES IN SEQ ID NO: (1)..(1494)
tgaacctgagagtttgatcctggctcagagcgaacgctggcggcatgcttaacacatgcaagtcgcacggacctttcggggtgagtggcggacgggtgagtatcgcgtagggatctatccatgggtgggggataacatcgggaaactggtgctaataccgcatgatacctgagggtcaaaggcgcaagtcgcctgtggaggagcctgcgttcgattagcttgttggtggggtaaaggcctaccaaggcgatgatcgatagctggtctgagaggatgatcagccacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttacacagtcagatgtgaaattccagggcttaaccttggggctgcatttgatacgtgtagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgacatggggaggctgtatccagagatgggtatttcccgcaagggacctcctgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgtcctgggctacacacgtgctacaatggcggtgacagtgggaagctagatggtgacatcgtgccgatctctaaaagccgtctcagttcggattgtactctgcaactcgagtgcatgaaggtggaatcgctagtaatcgcggatcagcatgccgcggtgaatacgttcccgggccttgtacacaccgcccgtcacaccatgggagttggtttgacccgaagccggtgagcgaaccgcaaggacgcagccgaccacggtcgggtcagcgactggggtgaagtcgtaacaaggtagccgtaggggaacctgcggctggatcacctcctttcaag

SEQ ID NO: 1518 - DNA, 1494 bp, Asaia sp. SF2.1; identical to SEQ ID NO: 1517
  ref <308>: DATABASE ACCESSION NUMBER: NCBI ACCESSION: NZ_AYXS01000023.1
  ref <309>: DATABASE ENTRY DATE: 2019-04-01
  ref <313>: RELEVANT RESIDUES IN SEQ ID NO: (1)..(1494)

SEQ ID NO: 1519 - DNA, 308 bp, Asaia sp. W19
  ref <308>: DATABASE ACCESSION NUMBER: NCBI ACCESSION: NZ_PNQZ01000050.1
  ref <309>: DATABASE ENTRY DATE: 2019-04-01
  ref <313>: RELEVANT RESIDUES IN SEQ ID NO: (1)..(308)
tgaacctgagagtttgatcctggctcagagcgaacgctggcggcatgcttaacacatgcaagtcgcacggacctttcggggtgagtggcggacgggtgagtaacgcgtagggatctatccatgggtgggggataacaccgggaaactggtgctaataccgcatgatacctgagggtcaaaggcgcgagtcgcctgtggaggagcctgcgttcgattagcttgttggtggggtaaaggcctaccaaggcgatgatcgatagctggtctgagaggatgatcagccacactgggactgagacacggcccag

SEQ ID NO: 1520 - DNA, 1525 bp, Asanoa ferruginea
  ref <308>: DATABASE ACCESSION NUMBER: NCBI ACCESSION: NZ_QUMQ01000001.1
  ref <309>: DATABASE ENTRY DATE: 2019-04-01
  ref <313>: RELEVANT RESIDUES IN SEQ ID NO: (1)..(1525)
tgttggagagtttgatcctggctcaggacgaacgctggcggcgtgcttaacacatgcaagtcgagcggaaaggcccttcggggtactcgagcggcgaacgggtgagtaacacgtgagtaacctgccctggactttgggataaccctcggaaacgggggctaataccgaatatccacgcttcatcgcatggtggtgtgtggaaagtttttcggtctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcgccggccaactacgtgccagcagccgcggtaagacgtagggcgcgagcgttgtccggatttattgggcgtaaagagctcgtaggcggcttgtcgcgtcggctgtgaaaacccgtggctcaactgcgggcttgcagccgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggctctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcaccgcaaaacttccagagatgggaggtccttcgggggcggtgacaggtggtgcatggctgtcgtcagctcgtgtcgtgagatgttgggttaagtcccgcaacgagcgcaaccctcgttcgatgttgccagcgggttatgccggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 1521 - DNA, 1525 bp, Asanoa hainanensis
  ref <308>: DATABASE ACCESSION NUMBER: NCBI ACCESSION: NZ_FZPH01000039.1
  ref <309>: DATABASE ENTRY DATE: 2019-04-01
  ref <313>: RELEVANT RESIDUES IN SEQ ID NO: (1)..(1525)
tgttggagagtttgatcctggctcaggacgaacgctggcggcgtgcttaacacatgcaagtcgagcggaaaggcccttcggggtactcgagcggcgaacgggtgagtaacacgtgagtaacctgccctggactttgggataaccctcggaaacgggggctaataccggatacctccttctggccgcatggttggttggggaaagtttttcggtctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcgccggccaactacgtgccagcagccgcggtaagacgtagggcgcgagcgttgtccggatttattgggcgtaaagagctcgtaggcggcttgtcgcgtcggctgtgaaatcccgtggctcaactgcgggcttgcagccgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggtcctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcaccgcaaaacttccagagatgggaggtccttcgggggcggtgacaggtggtgcatggctgtcgtcagctcgtgtcgtgagatgttgggttaagtcccgcaacgagcgcaaccctcgttcgatgttgccagcgggttatgccggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 1522 - DNA, 1525 bp, Asanoa ishikariensis
  ref <308>: DATABASE ACCESSION NUMBER: NCBI ACCESSION: NZ_FNQB01000011.1
  ref <309>: DATABASE ENTRY DATE: 2019-04-01
  ref <313>: RELEVANT RESIDUES IN SEQ ID NO: (1)..(1525)
tgttggagagtttgatcctggctcaggacgaacgctggcggcgtgcttaacacatgcaagtcgagcggaaaggcccttcggggtactcgagcggcgaacgggtgagtaacacgtgagtaacctgccctggactttgggataaccctcggaaacgggggctaataccgaatatccacggtctaccgcatggtgggttgtggaaagtttttcggtctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgaaagtgacggtacctgcagaagaagcgccggccaactacgtgccagcagccgcggtaagacgtagggcgcgagcgttgtccggatttattgggcgtaaagagctcgtaggcggcttgtcgcgtcggctgtgaaatcccgtggctcaactgcgggcttgcagccgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggctctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcaccgcaaaacttccagagatgggaggtccttcgggggcggtgacaggtggtgcatggctgtcgtcagctcgtgtcgtgagatgttgggttaagtcccgcaacgagcgcaaccctcgttcgatgttgccagcgggttatgccggggactcatcgaagactgccggggtcaactcggaggaaggtggggatgacgtcaagtcatcatgccccttatgtccagggcttcacgcatgctacaatggccggtacaatgggctgcgataccgtaaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 1523 - DNA, 1470 bp, Ascidiaceihabitans donghaensis
  ref <308>: DATABASE ACCESSION NUMBER: NCBI ACCESSION: NZ_OMOR01000001.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcctaacacatgcaagtcgagcgctaccttcgggtggagcggcggacgggttagtaacgcgtgggaatgtacccttctctatggaatagccattggaaacgatgagtaataccatatacgcccttcgggggaaagatttatcggagaaggatcagcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggatcagaaagtaaggggtgaaatcccagggctcaaccctggaactgcctcttaaactcctggtcttgagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcgtcgtcgctccagagatggagctttcagctaggctggacgagatacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttaggaggcagcggaccacggtaggatcagcgactggggtgaagtcgtaacaaggtagccgtaggggaacctgcggctggatcacctcctttctaa

SEQ ID NO: 1524 - DNA, 1328 bp, Asinibacterium sp. OR43
  ref <308>: DATABASE ACCESSION NUMBER: NCBI ACCESSION: NZ_ATYE01000013.1
  ref <309>: DATABASE ENTRY DATE: 2019-04-01
  ref <313>: RELEVANT RESIDUES IN SEQ ID NO: (1)..(1328)
attatagtttcgacgcttgaagatgggtgtgcggctgattaggtagttggcggggtaaaggcccaccaagccttcgatcagtagctgatgtgagagcatgatcagccacacgggcactgagacacgggcccgactcctacgggaggcagcagtaaggaatattggtcaatggacgcaagtctgaaccagccatgccgcgtgaaggatgaaggtcctctggattgtaaacttcttttatagggggcgaaaaaagggaattctttctcacttgacagtaccctatgaataagcaccggctaactccgtgccagcagccgcggtaatacggagggtgcaagcgttatccggattcactgggtttaaagggtgcgtaggcggataggtaagtcaggggtgaaatcctggagcttaactccagaactgcctttgatactatctatcttgaatatggtggaggtaagcggaatatgtcatgtagcggtgaaatgcatagatatgacatagaacacctattgcgaaggcagcttactacgcctatattgacgctgaggcacgaaagcgtggggatcaaacaggattagataccctggtagtccacgccctaaacgatgattactcgacgtatgcgatacacagtatgcgtctgagcgaaagcattaagtaatccacctgggaagtacgaccgcaaggttgaaactcaaaggaattggcgggggtccgcacaagcggtggagcatgtggtttaattcgatgatacgcgaggaaccttacctgggctagaatgcagtctgaccgtgggtgaaagctcatttcgtagcaatacgcagattgtaaggtgctgcatggctgtcgtcagctcgtgccgtgaggtgttgggttaagtcccgcaacgagcgcaacccctatcattagttgccaacaggtaaagctgggaactctagtgaaactgccgtcgtaagacgcgaggaaggaggggatgatgtcaagtcatcatggcctttatgcccagggctacacacgtgctacaatggggtggacaaagggctgcgacacagtgatgtgaagcgaatcccaaaaaccacttctcagttcagatcggagtctgcaactcgactccgtgaagctggaatcgctagtaatcgtatatcagcaatgatacggtgaatacgttcccggaccttgcacacaccgcccgtcaagccatgggagccgggtgtacctaaagtcggtaaccgcaaggatctgcctagggtaaaatcggtgactggggctaagtcgtaacaaggtagccgtaccggaaggtgcggctggaatacctccttttagag

SEQ ID NO: 1525 - DNA, 1465 bp, Asticcacaulis benevestitus
  ref <308>: DATABASE ACCESSION NUMBER: NCBI ACCESSION: NZ_AWGB01000110.1
  ref <309>: DATABASE ENTRY DATE: 2019-04-01
  ref <313>: RELEVANT RESIDUES IN SEQ ID NO: (1)..(1465)
caacctgagagtttgatcctggctcagagcgaacgctggcggcaggcctaacacatgcaagtcgaacgcaccttcgggtgagtggcggacgggtgagtaacacgtgggaacgtaccttttggttcggaataacgcagggaaacttgtgctaataccgaatgtgcccttcgggggaaagatttatcgccattagagcggcccgcgttagattagctagttggtgaggtaaaggctcaccaaggctacgatctatagctggtctgagaggatgatcagccacactgggactgagacacggcccagactcctacgggaggcagcagtggggaatcttgcgcaatgggcgaaagcctgacgcagccatgccgcgtgaatgatgaaggtcttaggattgtaaaattctttcagtagggacgataatgacggtacctacagaagaagccccggctaacttcgtgccagcagccgcggtaatacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacaggattagataccctggtagtccacgctgtaaacgatgattgctagttgtcggacggcatgccgttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggacatcatgggagaccatgctttctcttcggagactgggacacaggtgctgcatggctgtcgtcagctcgtgtcgtgagatgttgggttaagtcccgcaacgagcgcaaccctcgctgttagttgccatcattaagttgggaactctaacaggactgccggtgctaagccggaggaaggtggggatgacgtcaagtcctcatggcccttacagggtgggctacacacgtgctacaatggcgactacagagggcaaatccctaaaagtcgtctcagttcggatcgtcctctgcaactcgagggcgtgaagttggaatcgctagtaatcgcggatcagcatgccgcggtgaatacgttcccgggccttgtacacaccgcccgtcacaccatgggagttggttctacccgaaggcgctgcgctaacccgtaagggaggcaggcgaccacggtagggtcagcgactggggtgaagtcgtaacaaggtagccgtaggggaacctgcggctggatcacctcctttctaa

SEQ ID NO: 1526 - DNA, 1463 bp, Asticcacaulis biprosthecium
  ref <308>: DATABASE ACCESSION NUMBER: NCBI ACCESSION: NZ_GL883080.1
  ref <309>: DATABASE ENTRY DATE: 2019-04-01
  ref <313>: RELEVANT RESIDUES IN SEQ ID NO: (1)..(1463)
caacttgagagtttgatcctggctcagagcgaacgctggcggcaggcctaacacatgcaagtcgaacgagccttcgggctagtggcggacgggtgagtaacacgtgggaacgtacctttaggttcggaataactcagggaaacttgagctaataccgaatgtgcccttcgggggaaagatttatcgcctttagagcggcccgcgttagattagctagttggtgaggtaatggcccaccaaggctacgatctatagctggtctgagaggatgatcagccacactgggactgagacacggcccagactcctacgggaggcagcagtggggaatcttgcgcaatgggcgaaagcctgacgcagccatgccgcgtgaatgatgaaggtcttaggattgtaaaattcttttagcagggacgataatgacggtacctgcagaaaaagccccggctaacttcgtgccagcagccgcggtaatacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacaggattagataccctggtagtccacgctgtaaacgatgattgctagttgttggccggcatgccggtcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggacaacatgggagaccatgctttctcttcggagactgggacacaggtgctgcatggctgtcgtcagctcgtgtcgtgagatgttgggttaagtcccgcaacgagcgcaaccctcgctgttagttgccatcattaagttgggaactctaacaggactgccggtgctaagccggaggaaggtggggatgacgtcaagtcctcatggcccttacagggtgggctacacacgtgctacaatggcgactacagagggaaaatccctaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctaaccgcaaggaggcaggcgaccacggtagggtcagcgactggggtgaagtcgtaacaaggtagccgtaggggaacctgcggctggatcacctcctttctaa

SEQ ID NO: 1527 - DNA, 1464 bp, Asticcacaulis excentricus
  ref <308>: DATABASE ACCESSION NUMBER: NCBI ACCESSION: NZ_AP018827.1
  ref <309>: DATABASE ENTRY DATE: 2019-04-01
  ref <313>: RELEVANT RESIDUES IN SEQ ID NO: (1)..(1464)
caacttgagagtttgatcctggctcagagcgaacgctggcggcaggcctaacacatgcaagtcgaacgaagccttcgggcttagtggcggacgggtgagtaacacgtgggaacgtaccttttggttcggaacaactcagggaaacttgagctaataccggatgagcccttagggggaaagatttatcgccgaaagagcggcccgcgttagattagctagttggtgaggtaaaggctcaccaaggctacgatctatagctggtctgagaggatgatcagccacactgggactgagacacggcccagactcctacgggaggcagcagtggggaatcttgcgcaatgggcgaaagcctgacgcagccatgccgcgtgaatgatgaaggtcttaggattgtaaaattcttttaccagggacgataatgacggtacctggagaaaaagccccggctaacttcgtgccagcagccgcggtaatacgaagggggctagcgttgctcggaattactgggcgtaaagggagcgtaggcgggttgacaagttggaggtgaaagcccagggctcaaccctggaattgccttcaaaactgtcagccttgagtatggaagaggtaagtggaactccgagtgtagaggtgaaattcgtagatattcggaagaacaccagtggcgaaggcgacttactggtccatgactgacgctgaggctcgaaagcgtggggagcaaacaggattagataccctggtagtccacgccgtaaacgatgattgctagttgtcgggcagtatactgttcggtgacgcagctaacgcaataagcaatccgcctggggagtacggtcgcaagattaaaactcaaaggaattgacgggggcccgcacaagcggtggagcatgtggtttaattcgaagcaacgcgcagaaccttaccaccttttgacatgcccggctaaccagagagatttggtgttcccttcggggaccgggacacaggtgctgcatggctgtcgtcagctcgtgtcgtgagatgttgggttaagtcccgcaacgagcgcaaccctcgctgttagttgccatcatttagttgggaactctaacaggactgccggtgctaagccggaggaaggtggggatgacgtcaagtcctcatggcccttacggggtgggctacacacgtgctacaatggcgactacagagggaaaatccctaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttgggtttacccgaaggcagtgcgctaaccgtaagggggcagctgaccacggtaggctcagcgactggggtgaagtcgtaacaaggtagccgtaggggaacctgcggctggatcacctcctttcta

SEQ ID NO: 1528 - DNA, 1463 bp, Asticcacaulis sp. AC402
  ref <308>: DATABASE ACCESSION NUMBER: NCBI ACCESSION: NZ_AWGC01000064.1
  ref <309>: DATABASE ENTRY DATE: 2019-04-01
  ref <313>: RELEVANT RESIDUES IN SEQ ID NO: (1)..(1463)
caacttgagagtttgatcctggctcagagcgaacgctggcggcaggcctaacacatgcaagtcgaacgagccttcgggctagtggcggacgggtgagtaacacgtgggaacgtacctttaggttcggaataactcagggaaacttgagctaataccgaatgtgcccttcgggggaaagatttatcgcctttagagcggcccgcgttagattagctagttggtggggtaatggcccaccaaggctacgatctatagctggtctgagaggatgatcagccacactgggactgagacacggcccagactcctacgggaggcagcagtggggaatcttgcgcaatgggcgaaagcctgacgcagccatgccgcgtgaatgatgaaggtcttaggattgtaaaattcttttagcagggacgataatgacggtacctgcagaaaaagccccggctaacttcgtgccagcagccgcggtaatacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacaggattagataccctggtagtccacgctgtaaacgatgattgctagttgttggccggcatgccggtcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggacatcatgggagaccatgctttcccttcggggaccaggacacaggtgctgcatggctgtcgtcagctcgtgtcgtgagatgttgggttaagtcccgcaacgagcgcaaccctcgctgttagttgccatcatttagttgggaactctaacaggactgccggtgctaagccggaggaaggtggggatgacgtcaagtcctcatggcccttacagggtgggctacacacgtgctacaatggcgactacagagggcaaatccctaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctaaccgcaaggaggcaggcgaccacggtagggtcagcgactggggtgaagtcgtaacaaggtagccgtaggggaacctgcggctggatcacctcctttctaa

SEQ ID NO: 1529 - DNA, 1463 bp, Asticcacaulis sp. AC460
  ref <308>: DATABASE ACCESSION NUMBER: NCBI ACCESSION: NZ_AWGD01000055.1
  ref <309>: DATABASE ENTRY DATE: 2019-04-01
  ref <313>: RELEVANT RESIDUES IN SEQ ID NO: (1)..(1463)
caacttgagagtttgatcctggctcagagcgaacgctggcggcaggcctaacacatgcaagtcgaacgagccttcgggctagtggcggacgggtgagtaacacgtgggaacgtacctttaggttcggaataactcagggaaacttgagctaataccgaatgtgcccttcgggggaaagatttatcgcctttagagcggcccgcgttagattagctagttggtggggtaatggcccaccaaggctacgatctatagctggtctgagaggatgatcagccacactgggactgagacacggcccagactcctacgggaggcagcagtggggaatcttgcgcaatgggcgaaagcctgacgcagccatgccgcgtgaatgatgaaggtcttaggattgtaaaattcttttagcagggacgataatgacggtacctgcagaaaaagccccggctaacttcgtgccagcagccgcggtaatacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacaggattagataccctggtagtccacgctgtaaacgatgattgctagttgttggccggcatgccggtcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcccggacaacatgggagaccatgctttctcttcggagaccgggacacaggtgctgcatggctgtcgtcagctcgtgtcgtgagatgttgggttaagtcccgcaacgagcgcaaccctcgctgttagttgccatcattaagttgggaactctaacaggactgccggtgctaagccggaggaaggtggggatgacgtcaagtcctcatggcccttacagggtgggctacacacgtgctacaatggcgactacagagggcaaatccctaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctaaccgcaaggaggcaggcgaccacggtagggtcagcgactggggtgaagtcgtaacaaggtagccgtaggggaacctgcggctggatcacctcctttctaa

SEQ ID NO: 1530 - DNA, 1463 bp, Asticcacaulis sp. AC466
  ref <308>: DATABASE ACCESSION NUMBER: NCBI ACCESSION: NZ_AWGE01000034.1
  ref <309>: DATABASE ENTRY DATE: 2019-04-01
  ref <313>: RELEVANT RESIDUES IN SEQ ID NO: (1)..(1463)
caacctgagagtttgatcctggctcagagcgaacgctggcggcaggcctaacacatgcaagtcgaacgatccttcgggatagtggcggacgggtgagtaacacgtgggaacgtaccttttggttcggaataactcagggaaacttgagctaataccgaatgtgcccttcgggggaaagatttatcgccattagagcggcccgcgttagattagctagttggtggggtaaaggcccaccaaggctacgatctatagctggtctgagaggatgatcagccacattgggactgagacacggcccaaactcctacgggaggcagcagtggggaatcttgcgcaatggtcgaaagactgacgcagccatgccgcgtgaatgatgaaggtcttaggattgtaaaattctttcagtagggacgataatgacggtacctacagaagaagccccggctaacttcgtgccagcagccgcggtaatacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacaggattagataccctggtagtccacgctgtaaacgatgattgctagttgtcagccggcatgccggttggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccactcgagagatcgagctttcccttcggggactgggacacaggtgctgcatggctgtcgtcagctcgtgtcgtgagatgttgggttaagtcccgcaacgagcgcaaccctcgctgttagttgccatcattaagttgggaactctaacaggactgccggtgctaagccggaggaaggtggggatgacgtcaagtcctcatggcccttacagggtgggctacacacgtgctacaatggcgactacagagggtaaatccctaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctaaccgcaagggggcaggcgaccacggtagggtcagcgactggggtgaagtcgtaacaaggtagccgtaggggaacctgcggctggatcacctcctttctaa

SEQ ID NO: 1531 - DNA, 1464 bp, Asticcacaulis sp. CF398
  ref <308>: DATABASE ACCESSION NUMBER: NCBI ACCESSION: NZ_QBKE01000011.1
  ref <309>: DATABASE ENTRY DATE: 2019-04-01
  ref <313>: RELEVANT RESIDUES IN SEQ ID NO: (1)..(1464)
caacttgagagtttgatcctggctcagagcgaacgctggcggcaggcctaacacatgcaagtcgaacgaagccttcgggcttagtggcggacgggtgagtaacacgtgggaacgtacctttaggttcggaacaactcagggaaacttgagctaataccggataagcccttcgggggaaagatttatcgcctttagagcggcccgcgttagattagctagttggtgaggtaaaggctcaccaaggctacgatctatagctggtctgagaggatgatcagccacactgggactgagacacggcccagactcctacgggaggcagcagtggggaatcttgcgcaatgggcgaaagcctgacgcagccatgccgcgtgaatgatgaaggtcttaggattgtaaaattcttttaccagggacgataatgacggtacctggagaaaaagccccggctaacttcgtgccagcagccgcggtaatacgaagggggctagcgttgctcggaattactgggcgtaaagggagcgtaggcgggttgacaagttgggggtgaaagcccggagctcaactccggaattgccctcaaaactgtcagccttgagtatggaagaggtaagtggaactccgagtgtagaggtgaaattcgtagatattcggaagaacaccagtggcgaaggcgacttactggtccatgactgacgctgaggctcgaaagcgtggggagcaaacaggattagataccctggtagtccacgccgtaaacgatgattgctagttgtcgggcagcatgctgttcggtgacgcagctaacgcaataagcaatccgcctggggagtacggtcgcaagattaaaactcaaaggaattgacgggggcccgcacaagcggtggagcatgtggtttaattcgaagcaacgcgcagaaccttaccaccttttgacatgtccggctaatctcagagatgagacgttcctttcggggaccggaacacaggtgctgcatggctgtcgtcagctcgtgtcgtgagatgttgggttaagtcccgcaacgagcgcaaccctcgctgttagttgccatcatttagttgggaactctaacaggactgccggtgctaagccggaggaaggtggggatgacgtcaagtcctcatggcccttacggggtgggctacacacgtgctacaatggcgactacagagggaaaatccctaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttgggtttacccgaaggtagtgcgctaaccgcaaggaggcagctaaccacggtaggctcagcgactggggtgaagtcgtaacaaggtagccgtaggggaacctgcggctggatcacctcctttcta

SEQ ID NO: 1532 - DNA, 1464 bp, Asticcacaulis sp. YBE204
  ref <308>: DATABASE ACCESSION NUMBER: NCBI ACCESSION: NZ_AWGF01000024.1
  ref <309>: DATABASE ENTRY DATE: 2019-04-01
  ref <313>: RELEVANT RESIDUES IN SEQ ID NO: (1)..(1464)
taacctgagagtttgatcctggctcagagcgaacgctggcggcaggcctaacacatgcaagtcgaacgaagtcttcggacttagtggcggacgggtgagtaacacgtgggaacgtaccttttggttcggaacaactcagggaaacttgagctaataccgaatgtgcccttagggggaaagatttatcgccattagagcggcccgcgttagattagctagttggtgaggtaaaggctcaccaaggctacgatctatagctggtctgagaggatgatcagccacactgggactgagacacggcccagactcctacgggaggcagcagtggggaatcttgcgcaatgggcgaaagcctgacgcagccatgccgcgtgaatgatgaaggtcttaggattgtaaaattcttttagcagggacgataatgacggtacctgcagaaaaagccccggctaacttcgtgccagcagccgcggtaatacgaagggggctagcgttgctcggaattactgggcgtaaagggagcgtaggcgggttatcaagttggaggtgaaagcccagggctcaaccctggaattgccttcaaaactgatagccttgagtatggaagaggtaagtggaactccgagtgtagaggtgaaattcgtagatattcggaagaacaccagtggcgaaggcgacttactggtccatgactgacgctgaggctcgaaagcgtggggagcaaacaggattagataccctggtagtccacgctgtaaacgatgattgctagttgtcgggcggcatgccgttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgtccggctaacctgagagatcaggtgttcacttcggtgaccggaacacaggtgctgcatggctgtcgtcagctcgtgtcgtgagatgttgggttaagtcccgcaacgagcgcaaccctcgctgttagttgccatcattaagttgggaactctaacaggactgccggtgctaagccggaggaaggtggggatgacgtcaagtcctcatggcccttacggggtgggctacacacgtgctacaatggcgactacagagggaaaatccctaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttgggtttacccgaaggcagtgcgctaaccgcaaggaggcagctgaccacggtaggctcagcgactggggtgaagtcgtaacaaggtagccgtaggggaacctgcggctggatcacctcctttcta

SEQ ID NO: 1533 - DNA, 1553 bp, Atlantibacter hermannii
  ref <308>: DATABASE ACCESSION NUMBER: NCBI ACCESSION: NZ_LR134136.1
  ref <309>: DATABASE ENTRY DATE: 2019-04-01
  ref <313>: RELEVANT RESIDUES IN SEQ ID NO: (1)..(1553)
aaattgaagagtttgatcatggctcagattgaacgctggcggcaggcctaacacatgcaagtcgaacggtaacaggaagcagcttgctgcttcgctgacgagtggcggacgggtgagtaatgtctggggatctgcctgatggagggggataactactggaaacggtagctaataccgcataacgtcgcaagaccaaagagggggaccttcgggcctcttgccatcagatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaaacctgcggttggatcacctcccttaccttaaaga

SEQ ID NO: 1534 - DNA, 1078 bp, Atlantibacter subterranea
  ref <308>: DATABASE ACCESSION NUMBER: NCBI ACCESSION: NZ_RHXB01000036.1
  ref <309>: DATABASE ENTRY DATE: 2019-04-01
  ref <313>: RELEVANT RESIDUES IN SEQ ID NO: (1)..(1078)
tttcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaatttcgcagagatgcggaagtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaaga

SEQ ID NO: 1535 - DNA, 1564 bp, Atopobacter sp. AH10
  ref <308>: DATABASE ACCESSION NUMBER: NCBI ACCESSION: NZ_QXPZ01000038.1
  ref <309>: DATABASE ENTRY DATE: 2019-04-01
  ref <313>: RELEVANT RESIDUES IN SEQ ID NO: (1)..(1564)
tttcatgagagtttgatcctggctcaggacgaacgctggcggcgtgcctaatacatgcaagtcgaacgaagagcgaagaaacgcttgcgttttttcaatcttagtggcggacgggtgagtaacacgtgggtaacctgcccatcagtgggggataacagtcggaaacgactgctaataccgcataggtttctaagtcgcatgacttagaaaggaaagacggcctttgtgctgtcgctaatggatggacccgcggcgtattagctagttggtaaggtaacggcttaccaaggccatgatacgtagccgacctgagagggtaatcggccacattgggactgagacacggcccaaactcctacgggaggcagcagtagggaatcttccgcaatggacgaaagtctgacggagcaacgccgcgtgagtgaagacggtcttcggattgtaaaactctgttgtgagagaagaacaagcttttcagtaactggaaaagccttgacggtatctcaccagaaagccacggctaactacgtgccagcagccgcggtaatacgtaggtggcaagcgttgtccggatttattgggcgtaaagcgagcgcaggcggttccttaagtctgatgtgaaagcccacggcttaaccgtggaaggtcattggaaactggggaacttgagtgcagaagaggagagtggaattccatgtgtagcggtggaatgcgtagatatatggaggaacaccagtggcgaaggcgactctctggtctgtaactgacgctgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttatgattagttgccagcattcagttgggcactctagtgatactgccggtgacaaaccggaggaaggtggggatgacgtcaaatcagcatgccccttatgacttgggctacacacgtgctacaatggatggtacaacgagcagcaaactcgcaagagctagcgaatctcttaaagccattctcagttcggattgttctctgcaactcgagagcatgaagccggaatcgctagtaatcgcggatcagcacgccgcggtgaatacgttcccgggtcttgtacacaccgcccgtcacaccacgagagtttgtaacacccaaagccggtgaggtaaccttttggagccagccgtctaaggtgggatagatgattggggtgaagtcgtaacaaggtagccgtatcggaaggtgcggctggatcacctcctttctaaggaa

SEQ ID NO: 1536 - DNA, 1526 bp, Atopobium vaginae
  ref <308>: DATABASE ACCESSION NUMBER: NCBI ACCESSION: NZ_UFSV01000001.1
  ref <309>: DATABASE ENTRY DATE: 2019-04-01
  ref <313>: RELEVANT RESIDUES IN SEQ ID NO: (1)..(1526)
tttgaatggagagttcgatcctggctcaggatgaacgctggcggcgcgcctaacacatgcaagtcgaacggttaaagcatcttcggatgtgtataaagtggcgaacggctgagtaacacgtgggcaacctgccctttgcactgggatagcctcgggaaaccgaggttaataccggatactccatatttgtcgcatggcgaatatgggaaagctccggcggcaaaggatgggcccgcggcctgttagctagttggtggggtagtggcctaccaaggcaatgatgggtagccgggttgagagaccgaccggccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgaggccgcaaggtgacggtacctgcagaagaagccccggctaactacgtgccagcagccgcggtaatacgtagggggcaagcgttatccggattcattgggcgtaaagcgcgcgtaggcggtctgttaggtcaggagttaaatctgggggctcaacccctatccgctcctgataccggcaggcttgagtctggtaggggaagatggaattccaagtgtagcggtgaaatgcgcagatatttggaagaacaccggtggcgaaggcggtcttctgggccatgactgacgctgaggcgcgaaagctaggggagcgaacaggattagataccctggtagtcctagctgtaaacgatggacactaggtgtggggagattatactttccgtgccgcagctaacgcattaagtgtcccgcctggggagtacggtcgcaagactaaaactcaaaggaattgacgggggcccgcacaagcagcggagcatgtggcttaattcgaagcaacgcgaagaaccttaccagggcttgacatttaggtgaagcagtggaaacactgtggccgaaaggagcctaaacaggtggtgcatggctgtcgtcagctcgtgtcgtgagatgttgggttaagtcccgcaacgagcgcaacccttgtcgcatgttgccagcggttcggccgggcacccatgcgagaccgccggcgttaagccggaggaaggtggggacgacgtcaagtcatcatgccccttatgtcctgggctgcacacgtgctacaatggccggcacagagggctgctactgcgcgagcagaagcgaatccctaaagccggtcccagttcggattggaggctgcaactcgcctccatgaagtcggagttgctagtaatcgcggatcagcacgccgcggtgaatgcgttcccgggccttgtacacaccgcccgtcacaccacccgagtcgtctgcacccgaagtcgtcggcctaacccgcaagggagggaggcgccgaaggtgtggagggtaaggggggtgaagtcgtaacaaggtagccgtaccggaaggtgcggctggatcacctcctttctagggag

SEQ ID NO: 1537 - DNA, 300 bp, Atopococcus tabaci
  ref <308>: DATABASE ACCESSION NUMBER: NCBI ACCESSION: NZ_AUCD01000033.1
  ref <309>: DATABASE ENTRY DATE: 2019-04-01
  ref <313>: RELEVANT RESIDUES IN SEQ ID NO: (1)..(300)
gagagtttgatcctggctcaggacgaacgctggcggcatgcctaatacatgcaagtcgtacgctgaagtgctctgcttgcagagcgcggatgagtggcgaacgggtgagtaacacgtgggcaacctgcctgtaagatcgggataactccgggaaaccggggctaataccggataacccccgtctcctcctggagacgggttgaaaggcggcttcggctgtcgcttacagatgggcccgcggcgtattagcttgttggtggggtaacggcccaccaaggcgatgatacgtagccgacctga

SEQ ID NO: 1538 - DNA, 1263 bp, Atopostipes suicloacalis
  ref <308>: DATABASE ACCESSION NUMBER: NCBI ACCESSION: NZ_FQUF01000051.1
  ref <309>: DATABASE ENTRY DATE: 2019-04-01
  ref <313>: RELEVANT RESIDUES IN SEQ ID NO: (1)..(1263)
gaaagaaagacggctttgctgtcgcttatagatgatcccgcggcgtattagttagttggtggggtaatggcctaccaagaccatgatacgtagccgacctgagagggtgatcggccacactgggactgagacacggcccagactcctacgggaggcagcagtagggaatcttccacaatgggtgcaaacctgatggagcaatgccgcgtgaatgaagaaggtcttcggatcgtaaagttctgttattagagaagaacaagtcaaggagtaactgtcttgactttgacggtacctaaccagaaagtcacggctaactacgtgccagcagccgcggtaatacgtaggtgacaagcgttgtccggaattattgggcgtaaagggagcgcaggcggttggaatagtctgatgtgaaagcccacggcttaaccgtggaaggtcattggaaactgtccaacttgaatgcagaagaggtaagtggaattccatgtgtagcggtgaaatgcgtagatatatggaggaacaccagtggcgaaggcgacttactggtctgtgattgacgctgaggctcgaaagcgtgggtagcgaacaggattagataccctggtagtccacgccgtaaacgatgagtgctaagtgttggagggtttccgcccttcagtgctggagttaacgcattaagcactccgcctggggagtacgaccgcaaggttgaaactcaaaggaattgacggggacccgcacaagcggtggagcatgtggtttaattcgaagcaacgcgaagaaccttaccagctcttgacatcttctgatcaccctagagatagggctttcccttcggggacagaatgacaggtggtgcatggttgtcgtcagctcgtgtcgtgagatgttgggttaagtcccataacgagcgcaacccttattgttagttgccagcattcagttgggcactctagcgagactgccggtgataaaccggaggaaggtggggatgacgtcaaatcatcatgccccttatgagctgggctacacacgtgctacaatggacggtacaacgagttgcgaggccgcaaggcttagcgaatctttataagccgttctcagttcggattgctctctgcaactcgagagcatgaagccggaatcgctagtaatcgcggatcagaatgccgcggtgaatacgttcccgggtcttgtacacaccgcccgtcacaccacgagagtccgtaacacccgaagccggtggggcaacccttaggggag

SEQ ID NO: 1539 - DNA, 1493 bp, Aurantimonas coralicida
  ref <308>: DATABASE ACCESSION NUMBER: NCBI ACCESSION: NZ_BBWN01000045.1
  ref <309>: DATABASE ENTRY DATE: 2019-04-01
  ref <313>: RELEVANT RESIDUES IN SEQ ID NO: (1)..(1493)
aacctgagagtttgatcctggctcagaacgaacgctggcggcaggcttaacacatgcaagtcgaacgcatccttcggggtgagtggcagacgggtgagtaacgcgtgggaatctacccatccctacgggatagctccgggaaactggagataataccgtatacgtcctccgggagaaagatttatcggggatggatgagcccgcgttggattagctagttggtggggtaatggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctctgatactgggtgtcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacaggattagataccctggtagtccacgccgtaaacgatggaagctagccgtcggaggatttatccttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgcctcgacggtatccggagacggatgccttccttcgggacgagtgcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacagtgggcagccaactcgcgagagtgagctaatcccaaaaaaccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggtggtgcgctaacctagcaataggaggcagccaaccacggtagggtcagcgactggggtgaagtcgtaacaaggtagccgtaggggaacctgcggctggatcacctcctttctaagga

SEQ ID NO: 1540 - DNA, 1493 bp, Aurantimonas manganoxydans
  ref <308>: DATABASE ACCESSION NUMBER: NCBI ACCESSION: NZ_BBWP01000017.1
  ref <309>: DATABASE ENTRY DATE: 2019-04-01
  ref <313>: RELEVANT RESIDUES IN SEQ ID NO: (1)..(1493)
aacctgagagtttgatcctggctcagaacgaacgctggcggcaggcttaacacatgcaagtcgaacgcatccttcgggatgagtggcagacgggtgagtaacgcgtgggaatctacccatccctacgggatagctccgggaaactggagataataccgtatacgtcctccgggagaaagatttatcggggatggatgagcccgcgttggattagctagttggtggggtaatggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctctgatactgggtgtcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacaggattagataccctggtagtccacgccgtaaacgatggaagctagccgtcggaggatttatccttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgcctcgacggtatccggagacggatgccttccttcgggacgagtgcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacagtgggcagccaactcgcgagagtgagctaatcccaaaaaaccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggtggtgcgctaacctagcaataggaggcagccaaccacggtagggtcagcgactggggtgaagtcgtaacaaggtagccgtaggggaacctgcggctggatcacctcctttctaagga

SEQ ID NO: 1541 - DNA, 1430 bp, Aurantimonas sp. 22II-16-19i
  ref <308>: DATABASE ACCESSION NUMBER: NCBI ACCESSION: NZ_AQQS01000082.1
  ref <309>: DATABASE ENTRY DATE: 2019-04-01
  ref <313>: RELEVANT RESIDUES IN SEQ ID NO: (1)..(1430)
aacctgagagtttgatcctggctcagaacgaacgctggcggcaggcttaacacatgcaagtcgaacgcatccttcggggtgagtggcagacgggtgagtaacgcgtgggaatgtacctcttgctacgggatagctccgggaaactggaattaataccgtatgtgcccttcgggggaaagatttatcggcaagggatcagcccgcgttggattagctagttggtggggtaaaggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggacttttaagtcaggggtgaaatcccggggctcaaccccggaactgcctctgatactggaagtctcgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacaggattagataccctggtagtccacgccgtaaacgatggaagctagccgtcgggctgtttacagctcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgccacgacggttcccggagacgggttcctccctttgggcgtggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggcggtgacagtgggcagccaaccagcgatggtgagctaatcccaaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggcgttgcgctaacccgcaagggaggcaggcgaccacggtagggtcagcgactgggg

SEQ ID NO: 1542 - DNA, 1491 bp, Aurantimonas sp. Leaf443
  ref <308>: DATABASE ACCESSION NUMBER: NCBI ACCESSION: NZ_LMRD01000007.1
  ref <309>: DATABASE ENTRY DATE: 2019-04-01
  ref <313>: RELEVANT RESIDUES IN SEQ ID NO: (1)..(1491)
aacctgagagtttgatcctggctcagaacgaacgctggcggcaggcttaacacatgcaagtcgaacgccccgcaaggggagtggcagacgggtgagtaacgcgtgggaatctacccatctctacgggatagctccgggaaactggaattaataccgtatacgtcctgagggagaaagatttatcggggatggatgagcccgcgttggattagctagttggtggggtaatggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggggacgataatgacggtacccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaacggcctttgatactggatgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacaggattagataccctggtagtccacgccgtaaacgatggaagctagccgtcggggggtttacctttcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgcctcgacgccaactggagacggttggcttccttcgggacgagtgcacaggtgctgcatggctgtcgtcagctcgtgtcgtgagatgttgggttaagtcccgcaacgagcgcaaccctcgcccttagttgccagccttaagttgggcactctaaggggactgccggtgataagccgagaggaaggtggggatgacgtcaagtcctcatggcccttacgggctgggctacacacgtgctacaatggcggtgacagtgggcagccaaccagcgatggtgagctaatccccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggcgttgcgctaacctggcaacaggaggcaggcgaccacggtagggtcagcgactggggtgaagtcgtaacaaggtagccgtaggggaacctgcggctggatcacctcctttctaagga

SEQ ID NO: 1543 - DNA, 1488 bp, Aureimonas altamirensis
  ref <308>: DATABASE ACCESSION NUMBER: NCBI ACCESSION: NZ_FQZC01000007.1
  ref <309>: DATABASE ENTRY DATE: 2019-04-01
  ref <313>: RELEVANT RESIDUES IN SEQ ID NO: (1)..(1488)
aacctgagagtttgatcctggctcagaacgaacgctggcggcaggcttaacacatgcaagtcgaacgcacctttcggggtgagtggcagacgggtgagtaacgcgtgggaatctacccttctctacgggatagctccgggaaactggaattaataccgtatacgtcctgagggagaaagatttatcggggaaggatgagcccgcgttggattagctagttggtggggtaaaggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactggatatcttgagttcggaagaggtaagtggaattgcgagtgtagaggtgaaattcgtagatattcgcaggaacaccagtggcgaaggcggcttactggtccgatactgacgctgaggtgcgaaagcgtggggagcaaacaggattagataccctggtagtccacgccgtaaacgatggaagctagccgtcgggtgatttatcactcggtggcgcagcaaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgccacgacgattaccggagacggtattcttccttcgggacgtggacacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggcggtgacaatgggcagccaactcgcgagagtgcgctaatcccaaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggtggtgcgctaaccgcaaggaggcagccaaccacggtagggtcagcgactggggtgaagtcgtaacaaggtagccgtaggggaacctgcggctggatcacctcctttctaagg

SEQ ID NO: 1544 - DNA, 1489 bp, Aureimonas frigidaquae
  ref <308>: DATABASE ACCESSION NUMBER: NCBI ACCESSION: NZ_BBWR01000001.1
  ref <309>: DATABASE ENTRY DATE: 2019-04-01
  ref <313>: RELEVANT RESIDUES IN SEQ ID NO: (1)..(1489)
aacctgagagtttgatcctggctcagaacgaacgctggcggcaggcttaacacatgcaagtcgaacgcatccttcgggatgagtggcagacgggtgagtaacgcgtgggaatctacccatccctacgggatagctccgggaaactggaattaataccgtatacgtccttcgggagaaagatttatcggggatggatgagcccgcgttggattagctagttggtggggtaaaggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggaaatttaagtcaggggtgaaatcccggggctcaaccccggaactgcctttgatactgggtttcttgagttcggaagaggtaagtggaattgcgagtgtagaggtgaaattcgtagatattcgcaggaacaccagtggcgaaggcggcttactggtccgatactgacgctgaggtgcgaaagcgtggggagcaaacaggattagataccctggtagtccacgccgtaaacgatggaagctagccgttgggtgatttatcactcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgcctcgacggttaccggagacggtatccttccttcgggacggggacacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggcggtgacaatgggcagccaactcgcgagagtgcgctaatcccaaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggtggtgcgctaaccgcaaggaggcagccaaccacggtagggtcagcgactggggtgaagtcgtaacaaggtagccgtaggggaacctgcggctggatcacctcctttctaagga

SEQ ID NO: 1545 - DNA, 1488 bp, Aureimonas sp. AU12
  ref <308>: DATABASE ACCESSION NUMBER: NCBI ACCESSION: NZ_BBWH01000058.1
  ref <309>: DATABASE ENTRY DATE: 2019-04-01
  ref <313>: RELEVANT RESIDUES IN SEQ ID NO: (1)..(1488)
aacctgagagtttgatcctggctcagaacgaacgctggcggcaggcttaacacatgcaagtcgaacgccccgcaaggggagtggcagacgggtgagtaacgcgtgggaatctaccctttggtacgggatagctccgggaaactggaattaataccgtatgtgccctgaggggcaaagatttatcgccaaaggatgagcccgcgttggattagctagttggtggggtaaaggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggggacgataatgacggtacccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaacggcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacaggattagataccctggtagtccacgccgtaaacgatggaagctagccgtcggggggtttacctttcggtggcgcagcaaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgccctgacggtaccggagacggtgccattccttcgggacaggtgcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacagtgggcagccaaccagcgatggtgagctaatccccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggcgttgcgctaacccgcaagggaggcaggcgaccacggtagggtcagcgactggggtgaagtcgtaacaaggtagccgtaggggaacctgcggctggatcacctcctttctaagga

SEQ ID NO: 1546 - DNA, 1486 bp, Aureimonas sp. AU20
  ref <308>: DATABASE ACCESSION NUMBER: NCBI ACCESSION: NZ_BBWI01000062.1
  ref <309>: DATABASE ENTRY DATE: 2019-04-01
  ref <313>: RELEVANT RESIDUES IN SEQ ID NO: (1)..(1486)
aacctgagagtttgatcctggctcagaacgaacgctggcggcaggcttaacacatgcaagtcgagcgccccgcaaggggagcggcagacgggtgagtaacgcgtgggaatctaccctgaactgcggaatagctccgggaaactggaattaataccgcatgtgccctgaggggcaaagatttatcggttcaggatgagcccgcgtccgattagctagttggtggggtaaaggcctaccaaggcgacgatcggtagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtcttgagtccggaagaggtgagtggaattgcgagtgtagaggtgaaattcgtagatattcgcaggaacaccagtggcgaaggcggctcactggtccggtactgacgctgaggtgcgaaagcgtggggagcaaacaggattagataccctggtagtccacgccgtaaacgatggaagctagccgttgggggatttatctctcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgccctgacggctccagagatggggtcattccttcgggacaggtgcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacaatgggcagccagaccgcgaggtcgagctaatcccaaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggcgttgcgctaaccgtaaggaggcaggcgaccacggtagggtcagcgactggggtgaagtcgtaacaaggtagccgtaggggaacctgcggctggatcacctcctttctaagga

SEQ ID NO: 1547 - DNA, 1488 bp, Aureimonas sp. AU22
  ref <308>: DATABASE ACCESSION NUMBER: NCBI ACCESSION: NZ_BBWJ01000057.1
  ref <309>: DATABASE ENTRY DATE: 2019-04-01
  ref <313>: RELEVANT RESIDUES IN SEQ ID NO: (1)..(1488)
aacctgagagtttgatcctggctcagaacgaacgctggcggcaggcttaacacatgcaagtcgagcgccccgcaaggggagcggcagacgggtgagtaacgcgtgggaatctaccctgatctgcgggatagctccgggaaactggaattaataccgcatgtgccctgaggggcaaagatttatcggattgggatgagcccgcgtcggattagctagttggtggggtaaaggcctaccaaggcgacgatccgtagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggggacgataatgacggtacccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaacggcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacaggattagataccctggtagtccacgccgtaaacgatggaagctagccgtcggggggtttacctttcggtggcgcagccaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgccacgacgtccccagagatggggtcattccttcgggacgtggacacaggtgctgcatggctgtcgtcagctcgtgtcgtgagatgttgggttaagtcccgcaacgagcgcaaccctcgcccctagttgccagcatttggttgggcactctagggggactgccggtgataagccgagaggaaggtggggatgacgtcaagtcctcatggcccttacgggctgggctacacacgtgctacaatggcggtgacagtgggcagccaaccagcgatggtgagctaatccccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggcgttgcgctaacccgcgagggaggcaggcgaccacggtagggtcagcgactggggtgaagtcgtaacaaggtagccgtaggggaacctgcggctggatcacctcctttctaagga

SEQ ID NO: 1548 - DNA, 1488 bp, Aureimonas sp. AU4
  ref <308>: DATABASE ACCESSION NUMBER: NCBI ACCESSION: NZ_BBWK01000104.1
  ref <309>: DATABASE ENTRY DATE: 2019-04-01
  ref <313>: RELEVANT RESIDUES IN SEQ ID NO: (1)..(1488)
aacctgagagtttgatcctggctcagaacgaacgctggcggcaggcttaacacatgcaagtcgaacgccccgcaaggggagtggcagacgggtgagtaacgcgtgggaatctaccttgaactacgggatagctccgggaaactggaattaataccgtatgtgccctgagggggaaaggtttaccggttcaggatgagcccgcgtccgattagctagttggtggggtaaaggcctaccaaggcgacgatcggtagctggtctaagaggatgatcagccacattgggactgagacacggcccaaactcctacgggaggcagcagtggggaatattggacaatgggcgcaagcctgatccagccatgccgcgtgagtgatgaaggtcttaggattgtaaagctctttcaccggggacgataatgacggtacccggagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaacggcctttgatactgggtatcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacaggattagataccctggtagtccacgccgtaaacgatggaagctagccgtcggggggtttacccttcggtggcgcagccaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgcctcgacgggtccagagatgggctcattccttcgggacggggacacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacagtgggatgccaggcggcgacgccgagccaatccccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttgggtctacccgacgacggtgcgctaacccgcaagggaggcagccggccacggtaggctcagcgactggggtgaagtcgtaacaaggtagccgtaggggaacctgcggctggatcacctcctttctaagga

SEQ ID NO: 1549 - DNA, 1486 bp, Aureimonas sp. AU40
  ref <308>: DATABASE ACCESSION NUMBER: NCBI ACCESSION: NZ_BBWL01000066.1
  ref <309>: DATABASE ENTRY DATE: 2019-04-01
  ref <313>: RELEVANT RESIDUES IN SEQ ID NO: (1)..(1486)
aacctgagagtttgatcctggctcagaacgaacgctggcggcaggcttaacacatgcaagtcgagcgccccgcaaggggagcggcagacgggtgagtaacgcgtgggaatctaccctgaactgcggaatagctccgggaaactggaattaataccgcatgtgccctgaggggcaaagatttatcggttcaggatgagcccgcgtccgattagctagttggtggggtaaaggcctaccaaggcgacgatcggtagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtcttgagtccggaagaggtgagtggaattgcgagtgtagaggtgaaattcgtagatattcgcaggaacaccagtggcgaaggcggctcactggtccggtactgacgctgaggtgcgaaagcgtggggagcaaacaggattagataccctggtagtccacgccgtaaacgatggaagctagccgttgggggatttatctctcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgccctgacggctccagagatggggtcattccttcgggacaggtgcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacaatgggcagccagaccgcgaggtcgagctaatcccaaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggcgttgcgctaaccgcaaggaggcaggcgaccacggtagggtcagcgactggggtgaagtcgtaacaaggtagccgtaggggaacctgcggctggatcacctcctttctaagga

SEQ ID NO: 1550 - DNA, 1486 bp, Aureimonas sp. D3
  ref <308>: DATABASE ACCESSION NUMBER: NCBI ACCESSION: NZ_BBWM01000085.1
  ref <309>: DATABASE ENTRY DATE: 2019-04-01
  ref <313>: RELEVANT RESIDUES IN SEQ ID NO: (1)..(1486)
aacctgagagtttgatcctggctcagaacgaacgctggcggcaggcttaacacatgcaagtcgagcgccccgcaaggggagcggcagacgggtgagtaacgcgtgggaatctaccctgaactgcggaatagctccgggaaactggaattaataccgcatgtgccctgaggggcaaagatttatcggttcaggatgagcccgcgtccgattagctagttggtggggtaaaggcctaccaaggcgacgatcggtagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacaggattagataccctggtagtccacgccgtaaacgatggaagctagccgttgggggatttatctctcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgccctgacggctccagagatggagctattccttcgggacaggtgcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacagtgggcagccagaccgcgaggtcgagctaatcccaaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggcgttgcgctaaccgcaaggaggcaggcgaccacggtagggtcagcgactggggtgaagtcgtaacaaggtagccgtaggggaacctgcggctggatcacctcctttctaagga

SEQ ID NO: 1551 - DNA, 1489 bp, Aureimonas sp. Leaf324
  ref <308>: DATABASE ACCESSION NUMBER: NCBI ACCESSION: NZ_LMOH01000001.1
  ref <309>: DATABASE ENTRY DATE: 2019-04-01
  ref <313>: RELEVANT RESIDUES IN SEQ ID NO: (1)..(1489)
aacctgagagtttgatcctggctcagaacgaacgctggcggcaggcttaacacatgcaagtcgaacgccccgcaaggggagtggcagacgggtgagtaacgcgtgggaatctaccctgaactgcgggatagctccgggaaactggaattaataccgcatgtgccctgaggggcaaagattcatcggttcaggatgagcccgcgtccgattagctagttggtggggtaaaggcctaccaaggcgacgatcggtagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggggacgataatgacggtacccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaacggcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacaggattagataccctggtagtccacgccgtaaacgatggaagctagccgtcggggggtttacctttcggtggcgcagccaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgccacgacgtcctcagagatgaggtcattccttcgggacgtggacacaggtgctgcatggctgtcgtcagctcgtgtcgtgagatgttgggttaagtcccgcaacgagcgcaaccctcgcccctagttgccagcatttggttgggcactctagggggactgccggtgataagccggaggaaggtggggatgacgtcaagtcctcatggcccttacgggctgggctacacacgtgctacaatggcggtgacagtgggcagccagccagcgatggtgagctaatccccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggcgttgcgctaacctggcaacaggaggcaggcgaccacggtagggtcagcgactggggtgaagtcgtaacaaggtagccgtaggggaacctgcggctggatcacctcctttctaagga

SEQ ID NO: 1552 - DNA, 1494 bp, Aureimonas sp. Leaf427
  ref <308>: DATABASE ACCESSION NUMBER: NCBI ACCESSION: NZ_LMQW01000048.1
  ref <309>: DATABASE ENTRY DATE: 2019-04-01
  ref <313>: RELEVANT RESIDUES IN SEQ ID NO: (1)..(1494)
aacctgagagtttgatcctggctcagaacgaacgctggcggcaggcttaacacatgcaagtcgaacgccccgcaaggggagtggcagacgggtgagtaacgcgtgggaatctaccttgaactacgggatagctccgggaaactggaattaataccgtatgtggcctgagggcgaaagatttatcggttcaagatgagcccgcgttggattagctagttggtggggtaaaggcctaccaaggcgacgatccatagctggtctgagaggatgaccagccacattgggactgagacacggcccaaactcctacgggaggcagcagtggggaatattggacaatgggcgcaagcctgatccagccatgccgcgtgagtgatgaaggtcttaggattgtaaagctctttcaccggggacgataatgacggtacccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacaggattagataccctggtagtccacgccgtaaacgatggaagctagccgtcgggtgatttatcactcggtggcgcagccaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgccacgacggttaccggagacggtttccttccttcgggacgtggacacaggtgctgcatggctgtcgtcagctcgtgtcgtgagatgttgggttaagtcccgcaacgagcgcaaccctcgcctttagttgccagcatttggttgggcactctaaagggactgccggtgataagccgagaggaaggtggggatgacgtcaagtcctcatggcccttacgggctgggctacacacgtgctacaatggcggtgacagtgggcagccaactcgcgagagtgagctaatccccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggcgttgcgctaaccgagcaatcggaggcaggcgaccacggtagggtcagcgactggggtgaagtcgtaacaaggtagccgtaggggaacctgcggctggatcacctcctttctaaggatgc

SEQ ID NO: 1553 - DNA, 1494 bp, Aureimonas sp. Leaf454
  ref <308>: DATABASE ACCESSION NUMBER: NCBI ACCESSION: NZ_LMQT01000020.1
  ref <309>: DATABASE ENTRY DATE: 2019-04-01
  ref <313>: RELEVANT RESIDUES IN SEQ ID NO: (1)..(1494)
aacctgagagtttgatcctggctcagaacgaacgctggcggcaggcttaacacatgcaagtcgaacgccccgcaaggggagtggcagacgggtgagtaacgcgtgggaatctaccttgaactacgggatagctccgggaaactggaattaataccgtatgtgccctttgggggaaagattcatcggttcaagatgagcccgcgtccgattagctagttggtggggtaaaggcctaccaaggcgacgatcggtagctggtctgagaggatgaccagccacattgggactgagacacggcccaaactcctacgggaggcagcagtggggaatattggacaatgggcgcaagcctgatccagccatgccgcgtgagtgatgaaggtcttaggattgtaaagctctttcaccggggacgataatgacggtacccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacaggattagataccctggtagtccacgccgtaaacgatggaagctagccgtcgggtgatttatcactcggtggcgcagccaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgccacgacggttaccggagacggtttccttccttcgggacgtggacacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggcggtgacagtgggcagccaactcgcgagagtgagctaatccccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggcgttgcgctaactcagcaatgagaggcaggcgaccacggtagggtcagcgactggggtgaagtcgtaacaaggtagccgtaggggaacctgcggctggatcacctcctttctaaggatgc

SEQ ID NO: 1554 - DNA, 1485 bp, Aureimonas sp. M2BS4Y-1
  ref <308>: DATABASE ACCESSION NUMBER: NCBI ACCESSION: NZ_QYRN01000021.1
  ref <309>: DATABASE ENTRY DATE: 2019-04-01
  ref <313>: RELEVANT RESIDUES IN SEQ ID NO: (1)..(1485)
aacctgagagtttgatcctggctcagaacgaacgctggcggcaggcttaacacatgcaagtcgagcgccccgcgaggggagcggcagacgggtgagtaacgcgtgggaatctaccttgaactacgggatagctccgggaaactggaattaataccgtatgtggcctatgggcgaaagatttatcggttcaggatgagcccgcgtcggattagctagttggtggggtaaaggcctaccaaggcgacgatccgtagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggggacgataatgacggtacccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaacggcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacaggattagataccctggtagtccacgccgtaaacgatggaagctagccgtcggggggtttacctttcggtggcgcagccaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgcctcgcaggcaccagagatggtgtcgttccttcgggacgaggacacaggtgctgcatggctgtcgtcagctcgtgtcgtgagatgttgggttaagtcccgcaacgagcgcaaccctcgcccctagttgccagccttcagttgggcactctagggggactgccggtgataagccgagaggaaggtggggatgacgtcaagtcctcatggcccttacgggctgggctacacacgtgctacaatggcggtgacagtgggcagccaaccagcgatggtgagccaatccccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggcgttgcgctaacccgcaagggaggcaggcgaccacggtagggtcagcgactggggtgaagtcgtaacaaggtagccgtaggggaacctgcggctggatcacctcctttctaa

SEQ ID NO: 1555 - DNA, 1486 bp, Aureimonas sp. N4; identical to SEQ ID NO: 1550
  ref <308>: DATABASE ACCESSION NUMBER: NCBI ACCESSION: NZ_BBWS01000070.1
  ref <309>: DATABASE ENTRY DATE: 2019-04-01
  ref <313>: RELEVANT RESIDUES IN SEQ ID NO: (1)..(1486)

SEQ ID NO: 1556 - DNA, 1486 bp, Aureimonas ureilytica; identical to SEQ ID NO: 1550
  ref <308>: DATABASE ACCESSION NUMBER: NCBI ACCESSION: NZ_LDQA01000032.1
  ref <309>: DATABASE ENTRY DATE: 2019-04-01
  ref <313>: RELEVANT RESIDUES IN SEQ ID NO: (1)..(1486)

SEQ ID NO: 1557 - DNA, 1555 bp, Auricoccus indicus
  ref <308>: DATABASE ACCESSION NUMBER: NCBI ACCESSION: NZ_CP019573.1
  ref <309>: DATABASE ENTRY DATE: 2019-04-01
  ref <313>: RELEVANT RESIDUES IN SEQ ID NO: (1)..(1555)
atttgagagtttgatcctggctcaggatgaacgctggcggcgtgcctaatacatgcaagtcgagcgcgtttcgaaggtgcttgcaccttcaatgaaacgagcggcggacgggtgagtaacacgtaggtaacctacctttatgactgggataaccacgggaaaccggggctaataccggataagatttagcttcgcatgaagcagaagtaaaaggcagtttcggctgtcacataaagatggacctgcggcgcattagctagttggagaggtaagagctccccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgttaaggaagaacaccatggataggaaatgatcgatggatgacggtacttaaccagaaagccacggctaactacgtgccagcagccgcggtaatacgtaggtggcaagcgttatccggaattattgggcgtaaagcgcgcgtaggcggtttcttaagtctgatgtgaaagcccccggctcaaccggggagggtcattggaaactggggaacttgagtacagaagaggagagtggaattccatgtgtagcggtgaaatgcgcagagatatggaggaacaccagtggcgaaggcggctctctggtctgaaactgacgctgaggtgcgaaagcgtggggatcaaacaggattagataccctggtagtccacgctgtaaacgatgagtgctaagtgttagggggtttccgccccttagtgctgcagtaaacgcattaagcactccgcctggggagtacggccgcaaggttgaaactcaaaggaattgacggggacctgcacaagcggtggagcatgtggtttaattcgaagcaacgcgaagaaccttaccaaatcttgacatcctctgacaactttagagataaagtgtcccttcggggcagagagacaggtggtgcatggttgtcgtcagctcgtgtcgtgagatgttgggttaagtcccgcaacgagcgcaacccttaacattagttgccatcattgagttgggcactctaatgtgactgccggtgacaaaccggaggaaggtggggatgacgtcaaatcatcatgccccttatgatttgggctacacacgtgctacaatggataggaacaaagggtggcgaagtcgtgagatgaagcaaatcccataaaactattcccagttcggattgtagtctgcaactcgactacatgaaggtggaatcgctagtaatcgtggatcagcatgccacggtgaatacgttcccaggtcttgtacacaccgcccgtcacaccacgagagttcgtaacacccgaagccggtgggctaacaatgaggcagccgtcgaaggtgggacgaatgattggggtgaagtcgtaacaaggtagccgtatcggaaggtgcggctggatcacctcctttctaaggaa

SEQ ID NO: 1558 - DNA, 289 bp, Auritidibacter ignavus
  ref <308>: DATABASE ACCESSION NUMBER: NCBI ACCESSION: NZ_RDQR01000039.1
  ref <309>: DATABASE ENTRY DATE: 2019-04-01
  ref <313>: RELEVANT RESIDUES IN SEQ ID NO: (1)..(289)
ctgtgaggttgagctaatcccttaaagctggtctcagttcggattggggtctgcaactcgaccccatgaagtcggagtcgctagtaatcgcagatcagcaatgctgcggtgaatacgttcccgggccttgtacacaccgcccgtcgagtcacgaaagttggtaacacccgaagccggtggcctaaccgttgtggggggagccgtcgaaggtgggactggcgattgggactaagtcgtaacaaggtagccgtaccggaaggtgcggctggatcacctcctttctaaggag

SEQ ID NO: 1559 - DNA, 1527 bp, Auritidibacter sp. NML130574
  ref <308>: DATABASE ACCESSION NUMBER: NCBI ACCESSION: NZ_CP031746.1
  ref <309>: DATABASE ENTRY DATE: 2019-04-01
  ref <313>: RELEVANT RESIDUES IN SEQ ID NO: (1)..(1527)
tggagagtttgatcctggctcaggatgaacgctggcggcgtgcttaacacatgcaagtcgaacgatgaagctacagcttgctgtggtggattagtggcgaacgggtgagtatcacgtgagtaacctgcccttgactctgggataagcctgggaaactgggtctaatactggatatgacttctgaccgcatggttggttgtggaaagtttttgcggttttggatggactcgcggcctatcagcttgttggtggggtaatggcctaccaaggcttcgacgggtagccggcctgagagggtgaccggccacactgggactgagacacggcccagactcctacgggaggcagcagtgggggatattgcacaatgggcgcaagcctgatgcagcgacgtcgcgtgagggatgacggccttcgggttgtaaacctctttcagcagggaagaagctttggtgacggtacctgcagaagaagcaccggctaactacgtgccagcagccgcggtaatacgtagggtgcgagcgttatccggaattattgggcgtaaagagctcgtaggcggtttgtcgcgtctgctgtgaaagctcagggcttaactctgagtttgcagtgggtacgggcagactggagtgcagtaggggagattggaattcctggtgtagcggtggaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggatatttccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggatcgttccagagatggttcttccctttttgggctggtgtacaggtggtgcatggttgtcgtcagctcgtgtcgtgagatgttgggttaagtcccgcaacgagcgcaaccctcgttctatgttgccagcatttggttggggactcataggagactgccggggtcaactcggaggaaggtggggatgacgtcaaatcatcatgccccttatgtcttgggcttcacgcatgctacaatggccggtacagagggttgcgatactgtgaggttgagctaatcccttaaagctggtctcagttcggattggggtctgcaactcgaccccatgaagtcggagtcgctagtaatcgcagatcagcaatgctgcggtgaatacgttcccgggccttgtacacaccgcccgtcaagtcacgaaagttggtaacacccgaagccggtggcctaaccgttgtggggggagccgtcgaaggtgggactggcgattgggactaagtcgtaacaaggtagccgtaccggaaggtgcggctggatcacctcctttctaagga

SEQ ID NO: 1560 - DNA, 1543 bp, Azoarcus communis
  ref <308>: DATABASE ACCESSION NUMBER: NCBI ACCESSION: NZ_QKOE01000044.1
  ref <309>: DATABASE ENTRY DATE: 2019-04-01
  ref <313>: RELEVANT RESIDUES IN SEQ ID NO: (1)..(1543)
attgaacttaagagtttgatcctggctcagattgaacgctggcggcatgctttacacatgcaagtcgaacggcagcgggggcttcggcctgccggcgagtggcgaacgggtgagtaatgcatcggaacgtgcccagtcatgggggataactacgcgaaagcgtagctaataccgcatacgccctgagggggaaagtgggggatcttcggacctcacgtgattggagcggccgatgtcagattagctagttggtgaggtaaaggctcaccaaggcgacgatctgtagcgggtctgagaggatgatccgccacactgggactgagacacggcccagactcctacgggaggcagcagtggggaattttggacaatgggcgcaagcctgatccagccatgccgcgtgagtgaagaaggccttcgggttgtaaagctctttcgcaagggaagaaaacgtgtgggctaatatcctgcgcggatgacggtaccttgacaagaagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaactgcgcttgtgactgcacggctagagtacggcagaggggggtggaattcctggtgtagcagtgaaatgcgtagatatcaggaggaacaccgatggcgaaggcagccccctgggcctgtactgacgctcatgcacgaaagcgtggggagcaaacaggattagataccctggtagtccacgccctaaacgatgtcaactagttgttcgtagaggtaactctgtgagtaacgcagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatgtccagaaccctcgagagattgaggggtgccttcgggagctggaacacaggtgctgcatggctgtcgtcagctcgtgtcgtgagatgttgggttaagtcccgcaacgagcgcaacccttgtcattagttgccatcatttggttgggcactctaatgagactgccggtgacaaaccggaggaaggtggggatgacgtcaagtcctcatggcccttatgggtagggcttcacacgtcatacaatggtcggtacagagggttgccaagccgcgaggtggagctaatcccttaaagccgatcgtagtccggatcgtagtctgcaactcgactacgtgaagtcggaatcgctagtaatcgcagatcagcatgctgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttcaag

SEQ ID NO: 1561 - DNA, 1544 bp, Azoarcus sp. DN11
  ref <308>: DATABASE ACCESSION NUMBER: NCBI ACCESSION: NZ_CP021731.1
  ref <309>: DATABASE ENTRY DATE: 2019-04-01
  ref <313>: RELEVANT RESIDUES IN SEQ ID NO: (1)..(1544)
gattgaacttaagagtttgatcctggctcagattgaacgctggcggcatgctttacacatgcaagtcgaacggcagcgggggcttcggcctgccggcgagtggcgaacgggtgagtaatgcatcggaacgtgcccagtcatgggggataactacgcgaaagcgtagctaataccgcatacgccctgagggggaaagcgggggatcgcaagacctcgcgtgattggagcggccgatgtcggattagctagttggtggggtaaaggcctaccaaggcgacgatccgtagcgggtctgagaggatgatccgccacactgggactgagacacggcccagactcctacgggaggcagcagtggggaattttggacaatgggggcaaccctgatccagccatgccgcgtgagtgaagaaggccttcgggttgtaaagctctttcagacggaaagaaaacgcttcccctaatacgggaggtggatgacggtactgtcagaagaagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaactgcgcttgtgactgcacggctagagtacggcagaggggggtggaattccacgtgtagcagtgaaatgcgtagatatgtggaggaacaccgatggcgaaggcagccccctgggccgatactgacgctcatgcacgaaagcgtggggagcaaacaggattagataccctggtagtccacgccctaaacgatgtcgactagtcgttcggagaggtaactcactgagtgacgcagctaacgcgtgaagtcgaccgcctggggagtacggccgcaaggttaaaactcaaaggaattgacggggacccgcacaagcggtggatgatgtggattaattcgatgcaacgcgaaaaaccttacctacccttgacatgcctggaatcctgcagagatgcgggagtgccttcgggagccaggacacaggtgctgcatggctgtcgtcagctcgtgtcgtgagatgttgggttaagtcccgcaacgagcgcaacccttgtcgctaattgccatcattaagttgggcactttagcgagactgccggtgacaaaccggaggaaggtggggatgacgtcaagtcctcatggcccttatgggtagggcttcacacgtcatacaatggtcggtacagagggctgccaaagcgcgagctggagccaatcccttaaagccgatcgtagtccggatcgtagtctgcaactcgactacgtgaagtcggaatcgctagtaatcgcagatcagcatgctgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttcaag

SEQ ID NO: 1562 - DNA, 1550 bp, Azoarcus sp. SY39
  ref <308>: DATABASE ACCESSION NUMBER: NCBI ACCESSION: NZ_CP025682.1
  ref <309>: DATABASE ENTRY DATE: 2019-04-01
  ref <313>: RELEVANT RESIDUES IN SEQ ID NO: (1)..(1550)
gattgaacttaagagtttgatcctggctcagattgaacgctggcggcatgctttacacatgcaagtcgagcggcagcacgggtgcttgcacctggtggcgagcggcgaacgggtgagtaatgcatcggaacgtacccatgtggtgggggataaccactcgaaagagtggctaataccgcatacgccctgagggggaaagcgggggacttcttcgggagcctcgcgccattggagcggccgatgtcggattagctagtaggtggggtaaaggctcacctaggcgacgatccgtagctggtctgagaggatgatcagccacatcgggactgagacacggcccgaactcctacgggaggcagcagtggggaattttggacaatgggggcaaccctgatccagccatgccgcgtgagtgaagaaggccttcgggttgtaaagctctttcagtcgggaagaaacggggctctctaacatagggtcttaatgacggtaccgacagaagaagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaactgcgcttgtgactgcacggctagagtacggcagaggggggtggaattccacgtgtagcagtgaaatgcgtagagatgtggaggaacaccgatggcgaaggcagccccctgggccgatactgacgctcatgcacgaaagcgtgggtagcaaacaggattagataccctggtagtccacgccctaaacgatgccaactagtcgttcggagaggtaactttctgagtgacgcagctaacgcgtgaagttggccgcctggggagtacggtcgcaagattaaaactcaaaggaattgacggggacccgcacaagcggtggatgatgtggattaattcgatgcaacgcgaaaaaccttacctacccttgacatgcctggaacttggtagagataccttggtgccttcgggagccaggacacaggtgctgcatggctgtcgtcagctcgtgtcgtgagatgttgggttaagtcccgcaacgagcgcaacccttatcgttaattgccatcattgagttgggcactttagcgagactgccggtgacaaaccggaggaaggtggggatgacgtcaagtcctcatggcccttatgggtagggcttcacacgtcatacaatggtcggtacagagggttgccaagccgcgaggtggagctaatctcttaaagccgatcgtagtccggatcgtagtctgcaactcgactacgtgaagtcggaatcgctagtaatcgtggatcagcatgccacggtgaatacgttcccgggtcttgtacacaccgcccgtcacaccatgggagtgggtttcaccagaagtgggtagcttaacctctcgaggggggcgctcaccacggtgagattcatgactggggtgaagtcgtaacaaggtagccgtaggggaacctgcggctggatcacctcctttc

SEQ ID NO: 1563 - DNA, 1173 bp, Azoarcus toluclasticus
  ref <308>: DATABASE ACCESSION NUMBER: NCBI ACCESSION: NZ_KB899534.1
  ref <309>: DATABASE ENTRY DATE: 2019-04-01
  ref <313>: RELEVANT RESIDUES IN SEQ ID NO: (1)..(1173)
gattgaacttaagagtttgatcctggctcagattgaacgctggcggcatgctttacacatgcaagtcgaacggcagcgggggcttcggcctgccggcgagtggcgaacgggtgagtaatgcatcggaacgtgcccagtcatgggggataactacgcgaaagcgtagctaataccgcatacgccctgagggggaaagcgggggatcgcaagacctcgcgtgattggagcggccgatgtcggattagctagttggtggggtaaaggcctaccaaggcgacgatccgtagcgggtctgagaggatgatccgccacactgggactgagacacggcccagactcctacgggaggcagcagtggggaattttggacaatgggggcaaccctgatccagccatgccgcgtgagtgaagaaggccttcgggttgtaaagctctttcagacggaaagaaatcgggtgggtgaatagtctgcctggatgacggtactgtcagaagaagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaactgcgcttgtgactgcacagctagagtacggcagaggggggtggaattccacgtgtagcagtgaaatgcgtagatatgtggaggaacaccgatggcgaaggcagccccctgggccgatactgacgctcatgcacgaaagcgtggggagcaaacaggattagataccctggtagtccacgccctaaacgatgtcgactagtcgttcggagaggtaactcactgagtgacgcagctaacgcgtgaagtcgaccgcctggggagtacggccgcaaggttaaaactcaaaggaattgacggggacccgcacaagcggtggatgatgtggattaattcgatgcaacgcgaaaaaccttacctacccttgacatgcctggaatccttgagagatcagggagtgccttcgggagccaggacacaggtgctgcatggctgtcgtcagctcgtgtcgtgagatgttgggttaagtcccgcaacgagcgcaacccttgtcgttaattgccatcattaagttgggcactttagcgagactgccggtgacaaaccgg

SEQ ID NO: 1564 - DNA, 1545 bp, Azoarcus tolulyticus
  ref <308>: DATABASE ACCESSION NUMBER: NCBI ACCESSION: NZ_FTMD01000035.1
  ref <309>: DATABASE ENTRY DATE: 2019-04-01
  ref <313>: RELEVANT RESIDUES IN SEQ ID NO: (1)..(1545)
gattgaacttaagagtttgatcctggctcagattgaacgctggcggcatgctttacacatgcaagtcgaacggcagcgggggcttcggcctgccggcgagtggcgaacgggtgagtaatgcatcggaacgtgcccagtcatgggggataactacgcgaaagcgtagctaataccgcatacgccctgagggggaaagcgggggatcgcaagacctcgcgtgattggagcggccgatgtcggattagctagttggtggggtaaaggcctaccaaggcgacgatccgtagcgggtctgagaggatgatccgccacactgggactgagacacggcccagactcctacgggaggcagcagtggggaattttggacaatgggggcaaccctgatccagccatgccgcgtgagtgaagaaggccttcgggttgtaaagctctttcagacggaaagaaatcgggtgggtcaataccctgcctggatgacggtactgtcagaagaagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaactgcgcttgtgactgcacggctagagtacggcagaggggggtggaattccacgtgtagcagtgaaatgcgtagatatgtggaggaacaccgatggcgaaggcagccccctgggccgatactgacgctcatgcacgaaagcgtggggagcaaacaggattagataccctggtagtccacgccctaaacgatgtcgactagtcgttcggagaggtaactcactgagtgacgcagctaacgcgtgaagtcgaccgcctggggagtacggccgcaaggttaaaactcaaaggaattgacggggacccgcacaagcggtggatgatgtggattaattcgatgcaacgcgaaaaaccttacctacccttgacatgcctggaatccttgagagatcagggagtgccttcgggaaccaggacacaggtgctgcatggctgtcgtcagctcgtgtcgtgagatgttgggttaagtcccgcaacgagcgcaacccttgtcgctaattgccatcatttagttgggcactttagcgagactgccggtgacaaaccggaggaaggtggggatgacgtcaagtcctcatggcccttatgggtagggcttcacacgtcatacaatggtcggtacagagggctgccaaagcgcgagctggagccaatcccttaaagccgatcgtagtccggatcgtagtctgcaactcgactacgtgaagtcggaatcgctagtaatcgcagatcagcatgctgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttcaaga

SEQ ID NO: 1565 - DNA, 1546 bp, Azonexus fungiphilus
  ref <308>: DATABASE ACCESSION NUMBER: NCBI ACCESSION: NZ_RBXP01000008.1
  ref <309>: DATABASE ENTRY DATE: 2019-04-01
  ref <313>: RELEVANT RESIDUES IN SEQ ID NO: (1)..(1546)
gattgaactgaagagtttgatcctggctcagattgaacgctggcggcatgccttacacatgcaagtcgaacggcagcacgggcttcggtctggtggcgagtggcgaacgggtgagtaatgtatcggaacgtacccttcagtgggggataactatccgaaaggatagctaataccgcatattctctgaggaggaaagcgggggatcgcaagacctcgcgctgatggagcggccgatatcagattagctagttggtggggtaaaggcctaccaaggcgacgatctgtagcgggtctgagaggatgatccgccacactgggactgagacacggcccagactcctacgggaggcagcagtggggaattttggacaatgggggcaaccctgatccagccatgccgcgtgagtgaagaaggccttcgggttgtaaagctctttcggccgggaagaaatcgcgtgagttaataccttgcgtggatgacggtaccggaataagaagcaccggctaactacgtgccagcagccgcggtaatacgtagggtgcgagcgttaatcggaattactgggcgtaaagcgtgcgcaggcggttttttaagacaggcgtgaaatccccgggcttaacctgggaactgcgcttgtgactggaagactagagtatggcagaggggggtggaattccacgtgtagcagtgaaatgcgtagagatgtggaggaacaccgatggcgaaggcagccccctgggccaatactgacgctcatgcacgaaagcgtggggagcaaacaggattagataccctggtagtccacgccctaaacgatgtcaactaggtgttgggtgggtaaaaccatttagtaccgtagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatgttcagaatcctgaagagatttgggagtgcccgaaagggagctggaacacaggtgctgcatggctgtcgtcagctcgtgtcgtgagatgttgggttaagtcccgcaacgagcgcaacccttgtcgttaattgccatcatttagttgggcactttagcgagactgccggtgacaaaccggaggaaggtggggatgacgtcaagtcctcatggcccttatgggtagggcttcacacgtcatacaatggtcggtacagagggttgccaagccgcgaggtggagccaatcccagaaagccgatcgtagtccggatcgtaggctgcaactcgcctgcgtgaagtcggaatcgctagtaatcgcggatcagcatgtcgcggtgaatacgttcccgggtcttgtacacaccgcccgtcacaccatgggagcgggttccgccagaagtgggtagcctaaccgcaaggagggcgcttaccacggcggggttcgtgactggggtgaagtcgtaacaaggtagccgtaggggaacctgcggctggatcacctcctttctag

SEQ ID NO: 1566 - DNA, 1545 bp, Azonexus hydrophilus
  ref <308>: DATABASE ACCESSION NUMBER: NCBI ACCESSION: NZ_MTHD01000011.1
  ref <309>: DATABASE ENTRY DATE: 2019-04-01
  ref <313>: RELEVANT RESIDUES IN SEQ ID NO: (1)..(1545)
gattgaactgaagagtttgatcctggctcagattgaacgctggcggcatgccttacacatgcaagtcgaacggcagcacgggcttcggtctggtggcgagtggcgaacgggtgagtaatgcatcggaacgtacccgggagtgggggataactatccgaaaggatagctaataccgcatattctgtgcgcaggaaagcaggggatcttcggaccttgtgctcccggagcggccgatgtcagattagctagttggtggggtaaaggcctaccaaggcgacgatctgtagcgggtctgagaggatgatccgccacactggaactgagacacggtccagactcctacgggaggcagcagtggggaattttggacaatgggcgcaagcctgatccagccatgccgcgtgagtgaagaaggccttcgggttgtaaagctctttcggccgggaagaaatcgtacgggttaataccctgtgcggatgacggtaccggcataagaagcaccggctaactacgtgccagcagccgcggtaatacgtagggtgcgagcgttaatcggaattactgggcgtaaagcgtgcgcaggcggttttttaagataggcgtgaaatccccgggctcaacctgggaactgcgcttatgactggaagactagagtatggcagaggggggtggaattccacgtgtagcagtgaaatgcgtagagatgtggaggaacaccgatggcgaaggcagccccctgggccaatactgacgctcatgcacgaaagcgtggggagcaaacaggattagataccctggtagtccacgccctaaacgatgtcaactaggtgttgggtgggtaaaaccatttagtaccggagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatgccaggaacttgccagagatggcttggtgcccgaaagggagcctggacacaggtgctgcatggctgtcgtcagctcgtgtcgtgagatgttgggttaagtcccgcaacgagcgcaacccttgtcgttaattgccatcatttagttgggcactttagcgagactgccggtgacaaaccggaggaaggtggggatgacgtcaagtcctcatggcccttatgggtagggcttcacacgtcatacaatggtcggtacaaagggttgccaagccgcgaggtggagctaatcccagaaagccgatcgtagtccggatcgtaggctgcaactcgcctgcgtgaagtcggaatcgctagtaatcgtggatcagcatgtcacggtgaatacgttcccgggtcttgtacacaccgcccgtcacaccatgggagcgggttccgccagaagtgggtagcctaaccgcaaggagggcgcttaccacggcggggttcgtgactggggtgaagtcgtaacaaggtagccgtaggggaacctgcggctggatcacctcctttcta

SEQ ID NO: 1567 - DNA, 1489 bp, Azorhizobium caulinodans
  ref <308>: DATABASE ACCESSION NUMBER: NCBI ACCESSION: NC_009937.1
  ref <309>: DATABASE ENTRY DATE: 2019-04-01
  ref <313>: RELEVANT RESIDUES IN SEQ ID NO: (1)..(1489)
caacttgagagtttgatcctggctcagagcgaacgctggcggcaggcctaacacatgcaagtcgagcgcccagcaatgggagcggcagacgggtgagtaacgcgtggggatgtgcccaatggtgcggaataacccagggaaacttggattaataccgcatgtgcccttcgggggaaagatttatcgccattggatcaacccgcgtctgattagctagttggtgaggtaaaggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggtgaagataatgacggtaaccggagaagaagccccggctaacttcgtgccagcagccgcggtaatacgaagggggcaagcgttgctcggaatcactgggcgtaaagcgcacgtaggcggatcgttaagtcaggggtgaaagcctggagctcaactccagaactgcccttgatactggcgatcttgagttcgagagaggttggtggaactccgagtgtagaggtgaaattcgtagatattcggaagaacaccagtggcgaaggcggccaactggctcgatactgacgctgaggtgcgaaagcgtggggagcaaacaggattagataccctggtagtccacgccgtaaacgatggatgctagccgttggggagcttgctcttcagtggcgcagctaacgccttaagcatcccgcctggggagtacggtcgcaagattaaaactcaaaggaattgacgggggcccgcacaagcggtggagcatgtggtttaattcgaagcaacgcgcagaaccttaccagcctttgacatggcaggacgacttccggagacggatttcttccagcaatggacctgcacacaggtgctgcatggctgtcgtcagctcgtgtcgtgagatgttgggttaagtcccgcaacgagcgcaaccctcgcctttagttgccatcattcagttgggcactctaaagggactgccggtgataagccgcgaggaaggtggggatgacgtcaagtcctcatggcccttacgggctgggctacacacgtgctacaatggcggtgacaatgggatgcgagcctgcgagggtgagcaaatctccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggctttacccgaaggcgttgcgctaaccgcaaggaggcaggcgaccacggtagggtcagtgactggggtgaagtcgtaacaaggtagccgtaggggaacctgcggctggatcacctcctttctaagg

SEQ ID NO: 1568 - DNA, 1493 bp, Azorhizobium doebereinerae
  ref <308>: DATABASE ACCESSION NUMBER: NCBI ACCESSION: NZ_AXBA01000053.1
  ref <309>: DATABASE ENTRY DATE: 2019-04-01
  ref <313>: RELEVANT RESIDUES IN SEQ ID NO: (1)..(1493)
caacttgagagtttgatcctggctcagagcgaacgctggcggcaggcctaacacatgcaagtcgagcgcccagcaatgggagcggcagacgggtgagtaacgcgtggggatctgcccaatggtacggaataacccagggaaacttggattaataccgtatgtgcccttcgggggaaagatttatcgccattggatgaacccgcgtcggattagctagttggtgtggtaaaggcgcaccaaggcgacgatccgtagctggtctgagaggatgatcagccacactgggactgagacacggcccagactcctacgggaggcagcagtggggaatattggacaatgggcgcaagcctgatccagccatgccgcgtgtgtgatgaaggccttagggttgtaaagcactttcgccggtgaagataatgacggtaaccggagaagaagccccggctaacttcgtgccagcagccgcggtaatacgaagggggcaagcgttgctcggaatcactgggcgtaaagcgtacgtaggcgggtcgttaagtcaggggtgaaatcctggagctcaactccagaactgcccttgatactggcgatcttgagttcgagagaggttggtggaactgcgagtgtagaggtgaaattcgtagatattcgcaagaacaccagtggcgaaggcggccaactggctcgatactgacgctgaggtacgaaagcgtggggagcaaacaggattagataccctggtagtccacgccgtaaacgatggatgctagccgttaggcagcttgctgcttagtggcgcagctaacgcattaagcatcccgcctggggagtacggtcgcaagattaaaactcaaaggaattgacgggggcccgcacaagcggtggagcatgtggtttaattcgaagcaacgcgcagaaccttaccagcctttgacatggcaggacgacttccggagacggatttcttccagcaatggacctgcacacaggtgctgcatggctgtcgtcagctcgtgtcgtgagatgttgggttaagtcccgcaacgagcgcaaccctcgcctttagttgccatcattcagttgggcactctaaagggactgccggtgataagccgcgaggaaggtggggatgacgtcaagtcctcatggcccttacgggctgggctacacacgtgctacaatggcggtgacagtgggatgcgagcctgcgagggtgagcaaatctccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggcgttgcgctaacctagcaataggaggcaggcgaccacggtagggtcagcgactggggtgaagtcgtaacaaggtagccgtaggggaacctgcggctggatcacctcctttctaagg

SEQ ID NO: 1569 - DNA, 746 bp, Azospirillum brasilense
gagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggcgagcgttgttcggaattactgggcgtaaagggcgcgtaggcggcccgatcagtcagatgtgaaagccccgggctcaacctgggaactgcatttgatactgtcgggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgctggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgaca

SEQ ID NO: 1570 - DNA, 1504 bp, Azospirillum brasilense
gaacctgagagtttgatcctggctcagaacgaacgctggcggcatgcctaacacatgcaagtcgaacgagggcttcggccctagtggcgcacgggtgagtaacacgtgggaacctgcctttcggttcgggataacgtctggaaacggacgctaacaccggatacgtcccccagagagatttgggcggagaaagtttacgccgagagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggcgagcgttgttcggaattactgggcgtaaagggcgcgtaggcggcctgtttagtcagaagtgaaagccccgggcttaacctgggaacggcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgctggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactaccggctcgagagatcgggctttcagttcggctgggtggaacacaggtgctgcatggctgtcgtcagctcgtgtcgtgagatgttgggttaagtcccgcaacgagcgcaacccctaccgccagttgccatcattcagttgggcactctggtggaactgccggtgacaagccggaggaaggcggggatgacgtcaagtcctcatggcccttatgggttgggctacacacgtgctacaatggcggtgacagtgggacgcgaagtcgcaagatggagccaatccccaaaagccgtctcagttcggattgcactctgcaactcgggtgcatgaagttggaatcgctagtaatcgcggatcagcacgccgcggtgaatacgttcccgggccttgtacacaccgcccgtcacaccatgggagttggctttacccgaaggtggtgcgctaaccggcaacggaggcagccaaccacggtcaggtcagcgactggggtgaagtcgtaacaaggtagccgtaggggaacctgcggctggatcacctcctttctaagg

SEQ ID NO: 1571 - DNA, 1301 bp, Azospirillum brasilense
gagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggcgagcgttgttcggaattactgggcgtaaagggcgcgtaggcggcccgatcagtcagatgtgaaagccccgggctcaacctgggaactgcatttgatactgtcgggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgctggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccattgccggtccgagagattggaccttcagttcggctggatggaacacaggtgctgcatggctgtcgtcagctcgtgtcgtgagatgttgggttaagtcccgcaacgagcgcaacccctaccgccagttgccatcattcagttgggcactctggtggaactgccggtgacaagccggaggaaggcggggatgacgtcaagtcctcatggcccttatgggttgggctacacacgtgctacaatggcggtgacagtgggacgcgaagtcgcaagatggagcaaatccccaaaagccgtctcagttcggattgcactctgcaactcgggtgcatgaagttggaatcgctagtaatcgcggatcagcacgccgcggtgaatacgttcccgggccttgtacacaccgcccgtcacaccatgggagttggctttacccgaaggtggtgcgctaaccggcaacggaggcagccaaccacggtcaggtcagcgactggggtgaagtcgtaacaaggtagccgtaggggaacctgcggctggatcacctcctttctaagg

SEQ ID NO: 1572 - DNA, 1423 bp, Azospirillum brasilense
tagtggcgcacgggtgagtaacacgtgggaacctgccttatggttcgggataacgtctggaaacggacgctaacaccggatgtgccccccagagagatttgggtggggaaagtttacgccatgagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggcgagcgttgttcggaattactgggcgtaaagggcgcgtaggcggcccgatcagtcagatgtgaaagccccgggctcaacctgggaactgcatttgatactgtcgggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgctggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccattgccggtccgagagattggaccttcagttcggctggatggaacacaggtgctgcatggctgtcgtcagctcgtgtcgtgagatgttgggttaagtcccgcaacgagcgcaacccctaccgccagttgccatcattcagttgggcactctggtggaactgccggtgacaagccggaggaaggcggggatgacgtcaagtcctcatggcccttatgggttgggctacacacgtgctacaatggcggtgacagtgggacgcgaagtcgcaagatggagcaaatccccaaaagccgtctcagttcggattgcactctgcaactcgggtgcatgaagttggaatcgctagtaatcgcggatcagcacgccgcggtgaatacgttcccgggccttgtacacaccgcccgtcacaccatgggagttggctttacccgaaggtggtgcgctaaccggcaacggaggcagccaaccacggtcaggtcagcgactggggtgaagtcgtaacaaggtagccgtaggggaacctgcggctggatcacctcctttctaagg

SEQ ID NO: 1573 - DNA, 1282 bp, Azospirillum brasilense
  ref <308>: DATABASE ACCESSION NUMBER: NCBI ACCESSION: NZ_QXHE01000029.1
  ref <309>: DATABASE ENTRY DATE: 2019-04-01
  ref <313>: RELEVANT RESIDUES IN SEQ ID NO: (1)..(1282)
cttgaacctgagagtttgatcctggctcagaacgaacgctggcggcatgcctaacacatgcaagtcgaacgaaggcttcggccttagtggcgcacgggtgagtaacacgtgggaacctgcctttcggttcgggataacgtctggaaacggacgctaacaccggatacgtcccccagagagatttgggcggagaaagtttacgccgagagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggcgagcgttgttcggaattactgggcgtaaagggcgcgtaggcggcccgatcagtcagatgtgaaagccccgggctcaacctgggaactgcatttgatactgtcgggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgctggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactaccggctcgagagatcgggctttcagttcggctgggtggaacacaggtgctgcatggctgtcgtcagctcgtgtcgtgagatgttgggttaagtcccgcaacgagcgcaacccctaccgccagttgccatcattcagttgggcactctggtggaactgccggtgacaagccggaggaaggcggggatgacgtcaagtcctcatggcccttatgggttgggctacacacgtgctacaatggcggtgacagtgggatgcgaagtcgcaagatggagccaatccccaaaagccgtctcagttcggattgcactctgcaactcggg

SEQ ID NO: 1574 - DNA, 1491 bp, Azospirillum doebereinerae
  ref <308>: DATABASE ACCESSION NUMBER: NCBI ACCESSION: NZ_RZIJ01000065.1
  ref <309>: DATABASE ENTRY DATE: 2019-04-01
  ref <313>: RELEVANT RESIDUES IN SEQ ID NO: (1)..(1491)
gaacctgagagtttgatcctggctcagaacgaacgctggcggcatgcctaacacatgcaagtcgaacggtgccttcgggcacagtggcgcacgggtgagtaacacgtgggaatctgcctttcggttcggaataacgtttggaaacgaacgctaacaccggatacgcccttcgggggaaagttcacgccgagagaggagcccgcgtccgattaggtagttggtgaggtaacggctcaccaagccgacgatcggtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgtgacgatgatgacggtaacgtgagaagaagccccggctaacttcgtgccagcagccgcggtaatacgaagggggctagcgttgttcggaattactgggcgtaaagggcgcgtaggcggcctgtttagtcggaagtgaaagccccgggctcaacctgggaattgctttcgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactaccggtctcagagatgggactttcggttcggccgggtggaacacaggtgctgcatggctgtcgtcagctcgtgtcgtgagatgttgggttaagtcccgcaacgagcgcaacccctactgccagttgccatcattcagttgggcactctggtggaactgccggtgacaagccggaggaaggcggggatgacgtcaagtcctcatggcccttatgggttgggctacacacgtgctacaatggcggtgacagtgggacgcgaagccgcgaggtggagccaatccccaaaagccgtctcagttcggatcgcactctgcaactcgagtgcgtgaagttggaatcgctagtaatcgcggatcagcacgccgcggtgaatacgttcccgggccttgtacacaccgcccgtcacaccatgggagttggctttacccgaagacggtgcgttaacccgcaagggagacagccggccacggtaaggtcagcgactggggtgaagtcgtaacaaggtagccgtaggggaacctgcggctggatcacctcctttctaagg

SEQ ID NO: 1575 - DNA, 1410 bp, Azospirillum formosense
tagtggcgcacgggtgagtaacacgtgggaacctgccttatggttcgggataacgtctggaaacggacgctaacaccggatgtgcccttcgggggaaagtttacgccatgagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggcgagcgttgttcggaattactgggcgtaaagggcgcgtaggcggcccgatcagtcagatgtgaaagccccgggctcaacctgggaactgcatttgatactgtcgggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgctggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccattgccggtccgagagattggaccttcagttcggctggatggaacacaggtgctgcatggctgtcgtcagctcgtgtcgtgagatgttgggttaagtcccgcaacgagcgcaacccctaccgccagttgccatcattcagttgggcactctggtggaactgccggtgacaagccggaggaaggcggggatgacgtcaagtcctcatggcccttatgggttgggctacacacgtgctacaatggcggtgacagtgggacgcgaagtcgcaagatggagcaaatccccaaaagccgtctcagttcggattgcactctgcaactcgggtgcatgaagttggaatcgctagtaatcgcggatcagcacgccgcggtgaatacgttcccgggccttgtacacaccgcccgtcacaccatgggagttggctttacccgaaggtggtgcgctaaccggcaacggaggcagccaaccacggtcaggtcagcgactggggtgaagtcgtaacaaggtagccgtaggggaacctgcggctggatcacctcctttctaagg

SEQ ID NO: 1576 - DNA, 1491 bp, Azospirillum formosense
gaacctgagagtttgatcctggctcagaacgaacgctggcggcatgcctaacacatgcaagtcgaacgagggcttcggccctagtggcgcacgggtgagtaacacgtgggaacctgccttatggttcgggataacgtctggaaacggacgctaacaccggatgtgcccttcgggggaaagtttacgccatgagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggcgagcgttgttcggaattactgggcgtaaagggcgcgtaggcggcccgatcagtcagatgtgaaagccccgggctcaacctgggaactgcatttgatactgtcgggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgctggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccattgccggtccgagagattggaccttcagttcggctggatggaacacaggtgctgcatggctgtcgtcagctcgtgtcgtgagatgttgggttaagtcccgcaacgagcgcaacccctaccgccagttgccatcattcagttgggcactctggtggaactgccggtgacaagccggaggaaggcggggatgacgtcaagtcctcatggcccttatgggttgggctacacacgtgctacaatggcggtgacagtgggacgcgaagtcgcaagatggagcaaatccccaaaagccgtctcagttcggattgcactctgcaactcgggtgcatgaagttggaatcgctagtaatcgcggatcagcacgccgcggtgaatacgttcccgggccttgtacacaccgcccgtcacaccatgggagttggctttacccgaaggtggtgcgctaaccggcaacggaggcagccaaccacggtcaggtcagcgactggggtgaagtcgtaacaaggtagccgtaggggaacctgcggctggatcacctcctttctaagg

SEQ ID NO: 1577 - DNA, 1410 bp, Azospirillum formosense; identical to SEQ ID NO: 1575

SEQ ID NO: 1578 - DNA, 1492 bp, Azospirillum humicireducens
  ref <308>: DATABASE ACCESSION NUMBER: NCBI ACCESSION: NZ_CP015285.1
  ref <309>: DATABASE ENTRY DATE: 2019-04-01
  ref <313>: RELEVANT RESIDUES IN SEQ ID NO: (1)..(1492)
gaacctgagagtttgatcctggctcagaacgaacgctggcggcatgcctaacacatgcaagtcgaacgaaggcttcggccttagtggcgcacgggtgagtaacacgtgggaacctgcctttcggttcggaataacgtttggaaacgaacgctaacaccggatacgtccttcgggagaaagtttacgccgagagaggggcccgcgtcggattaggtagttggtgaggtaatggctcaccaagcctgcgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcctgtttagtcagaagtgaaagccccgggctcaacctgggaatagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccatttcgaacccgagagattgggtttttcagttcggctgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggaagcgaagtcgcgagatggagccaatccccaaaagccgtctcagttcggatcgtactctgcaactcgagtgcgtgaagttggaatcgctagtaatcgcggatcagcacgccgcggtgaatacgttcccgggccttgtacacaccgcccgtcacaccatgggagttggctttacccgaaggtggtgcgctaacccgtaagggaggcagccaaccacggtaaggtcagcgactggggtgaagtcgtaacaaggtagccgtaggggaacctgcggctggatcacctcctttctaagg

SEQ ID NO: 1579 - DNA, 1499 bp, Azospirillum lipoferum
  ref <308>: DATABASE ACCESSION NUMBER: NCBI ACCESSION: NZ_FXBR01000004.1
  ref <309>: DATABASE ENTRY DATE: 2019-04-01
  ref <313>: RELEVANT RESIDUES IN SEQ ID NO: (1)..(1499)
ttgaacctgagagtttgatcctggctcagaacgaacgctggcggcatgcctaacacatgcaagtcgaacggtggcttcggccacagtggcgcacgggtgagtaacacgtgggaacctgcctttcggttcggaataacgtctggaaacggacgctaacaccggatacgcccttcgggggaaagtttacgccgagagaggggcccgcgtccgattaggtagttggtgaggtaacggctcaccaagccgacgatcggtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcctgtttagtcggaagtgaaagccccgggctcaacctgggaattgctttcgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactaccggttcgagagatcggactttcagttcggctgggtggaacacaggtgctgcatggctgtcgtcagctcgtgtcgtgagatgttgggttaagtcccgcaacgagcgcaacccctactgccagttgccatcattcagttgggcactctggtggaactgccggtgacaagccggaggaaggcggggatgacgtcaagtcctcatggcccttatgggttgggctacacacgtgctacaatggcggtgacagtgggacgcgaagccgcgaggtggagccaatccccaaaagccgtctcagttcggatcgcactctgcaactcgagtgcgtgaagttggaatcgctagtaatcgcggatcagcacgccgcggtgaatacgttcccgggccttgtacacaccgcccgtcacaccatgggagttggctttacccgaagacggtgcgctaacctcgcaagaggaggcagccggccacggtcaggtcagcgactggggtgaagtcgtaacaaggtagccgtaggggaacctgcggctggatcacctcctttctaaggacgc

SEQ ID NO: 1580 - DNA, 1518 bp, Azospirillum oryzae
  ref <308>: DATABASE ACCESSION NUMBER: NCBI ACCESSION: NZ_FXAK01000002.1
  ref <309>: DATABASE ENTRY DATE: 2019-04-01
  ref <313>: RELEVANT RESIDUES IN SEQ ID NO: (1)..(1518)
aggcttcggtcttgcgatctgaacctgagagtttgatcctggctcagaacgaacgctggcggcatgcctaacacatgcaagtcgaacgaaggcttcggccttagtggcgcacgggtgagtaacacgtgggaacctgccttatggttcggaataacgtctggaaacggacgctaacaccggatgtgcccttcgggggaaagtttacgccatgagaggggcccgcgtcggattaggtagttggtgtggtaacggcgcaccaagccgacgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcctgtttagtcagaagtgaaagccccgggctcaacctgggaatagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactatgggctcgagagatcgggtccttcagttcggctgggtggaacacaggtgctgcatggctgtcgtcagctcgtgtcgtgagatgttgggttaagtcccgcaacgagcgcaacccctactgtcagttgccatcattcagttgggcactctggtggaaccgccggtgacaagccggaggaaggcggggatgacgtcaagtcctcatggcccttatgggttgggctacacacgtgctacaatggcggtgacagtgggacgcgaagccgcgaggtggagcaaatccccaaaagccgtctcagttcggatcgtactctgcaactcgagtgcgtgaagttggaatcgctagtaatcgcggatcagcacgccgcggtgaatacgttcccgggccttgtacacaccgcccgtcacaccatgggagttggctttacccgaagacggtgcgctaacccagcaatgggaggcagccggccacggtaaggtcagcgactggggtgaagtcgtaacaaggtagccgtaggggaacctgcggctggatcacctcctttctaaggacgc

SEQ ID NO: 1581 - DNA, 1509 bp, Azospirillum sp. B4
  ref <308>: DATABASE ACCESSION NUMBER: NCBI ACCESSION: NZ_BACU01000138.1
  ref <309>: DATABASE ENTRY DATE: 2019-04-01
  ref <313>: RELEVANT RESIDUES IN SEQ ID NO: (1)..(1509)
cattgaacctgagagtttgatcctggctcagaacgaacgctggcggcatgcctaacacatgcaagtcgaacgaaggcttcggccttagtggcgcacgggtgagtaacgcgtgggaacctgccctttggttcggaataactccgggaaactggagctaataccggatgagccgatcagctgtggaggctggttgggaaagatttatcgccgaaggaggggcccgcgtccgattaggtagttggtgaggtaacggctcaccaagccgacgatcggtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgtgacgatgatgacggtaacgtgagaagaagccccggctaacttcgtgccagcagccgcggtaatacgaagggggctagcgttgttcggaattactgggcgtaaagggcgcgtaggcggctgttcaagtcaggcgtgaaatccccgggcttaacctgggaattgcgtttgagactgagcggcttgagttcgggagaggtgagtggaattcccagtgtagaggtgaaattcgtagatattgggaagaacaccggtggcgaaggcggctcactggaccgatactgacgctgaggcgcgaaagcgtggggagcaaacaggattagataccctggtagtccacgccgtaaacgatgagtgctagacgttggggcccttagggtttcagtgtcgcagctaacgcattaagcactccgcctggggagtacggccgcaaggttgaaactcaaaggaattgacgggggcccgcacaagcggtggagcatgtggtttaattcgaagcaacgcgcagaaccttaccagctcttgacatctactgaccggtgcggagacgcactttccacttcggtggcggtaagacaggtgctgcatggctgtcgtcagctcgtgtcgtgagatgttgggttaagtcccgcaacgagcgcaacccccatcttcagttgccatcatttggttgggcactctggagaaactgccggtgacaagccggaggaaggcggggatgacgtcaagtcctcatggcccttatgggctgggctacacacgtgctacaatggtggtgacagtgggcagcgacctcgtgagggggagctaatctccaaaagccatctcagttcggattgtactctgcaactcgagtgcatgaagttggaatcgctagtaatcgcggatcagcacgccgcggtgaatacgttcccgggccttgtacacaccgcccgtcacaccatgggagttggctttacccgaagccggtgcgctaaccgcaaggaggcagccgaccacggtacggtcagcgactggggtgaagtcgtaacaaggtagccgtaggggaacctgcggctggatcacctcctttctaagga

SEQ ID NO: 1582 - DNA, 1510 bp, Azospirillum sp. B506
  ref <308>: DATABASE ACCESSION NUMBER: NCBI ACCESSION: NZ_BADK01000995.1
  ref <309>: DATABASE ENTRY DATE: 2019-04-01
  ref <313>: RELEVANT RESIDUES IN SEQ ID NO: (1)..(1510)
tgaacctgagagtttgatcctggctcagaacgaacgctggcggcatgcctaacacatgcaagtcgaacgaaggcttcggccttagtggcgcacgggtgagtaacacgtgggaacctgcctttcggttcggaataacgtctggaaacggacgctaacaccggatacgtcccccagagaaatttgggcggagaaagtttacgccgagagaggggcccgcgtcggattaggtagttggtgaggtaatggctcaccaagcctacgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcctgtttagtcagaagtgaaagccccgggctcaacctgggaatagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactatgggcttcagagatgaggtccttcggttcggccgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggaagcgaagtcgcgagatggagccaatccccaaaagccgtctcagttcggattgcactctgcaactcgagtgcatgaagttggaatcgctagtaatcgcggatcagcacgccgcggtgaatacgttcccgggccttgtacacaccgcccgtcacaccatgggagttggctttacccgaaggtggtgcgctaacccgcaagggaggcagccaaccacggtaaggtcagcgactggggtgaagtcgtaacaaggtagccgtaggggaacctgcggctggatcacctcctttctaaggaagc

SEQ ID NO: 1583 - DNA, 1506 bp, Azospirillum sp. CFH 70021
  ref <308>: DATABASE ACCESSION NUMBER: NCBI ACCESSION: NZ_CP029356.1
  ref <309>: DATABASE ENTRY DATE: 2019-04-01
  ref <313>: RELEVANT RESIDUES IN SEQ ID NO: (1)..(1506)
gaacctgagagtttgatcctggctcagaacgaacgctggcggcatgcctaacacatgcaagtcgaacggtggcttcggccacagtggcgcacgggtgagtaacacgtgggaacctgcctttcggttcgggataacgtctggaaacggacgctaacaccggatacgtccttcctggagacaggttggggaaagttcacgccgagagaggggcccgcgtccgattaggtagttggtgaggtaacggctcaccaagccgacgatcggtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcctgtttagtcagaagtgaaagccccgggctcaacctgggaaccgcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccagcccttgacatgtccactatggtgaccagagacggtcaccttcggttcggccgggtggaacacaggtgctgcatggctgtcgtcagctcgtgtcgtgagatgttgggttaagtcccgcaacgagcgcaacccccactgccagttgccatcattcagttgggcactctggtggaactgccggtgacaagccggaggaaggcggggatgacgtcaagtcctcatggcccttatgggctgggctacacacgtgctacaatggcggtgacagtgggacgcgaagccgtgaggtggagccaatccccaaaagccgtctcagttcggattgcactctgcaactcgagtgcatgaagttggaatcgctagtaatcgcggatcagcacgccgcggtgaatacgttcccgggccttgtacacaccgcccgtcacaccatgggagttggctttacccgaagacggtgcgctaacccagcaatgggaggcagccggccacggtcaggtcagcgactggggtgaagtcgtaacaaggtagccgtaggggaacctgcggctggatcacctcctttctaagg

SEQ ID NO: 1584 - DNA, 1493 bp, Azospirillum sp. L-25-5w-1
  ref <308>: DATABASE ACCESSION NUMBER: NCBI ACCESSION: NZ_RXMA01000091.1
  ref <309>: DATABASE ENTRY DATE: 2019-04-01
  ref <313>: RELEVANT RESIDUES IN SEQ ID NO: (1)..(1493)
tcgaacctgagagtttgatcctggctcagaacgaacgctggcggcatgcctaacacatgcaagtcgaacgatggcttcggccatagtggcgcacgggtgagtaacacgtgggaacctgcctttcggttcggaataacgtttggaaacgaacgctaacaccggatacgccctttgggggaaagtttacgccgagagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgtgacgatgatgacggtaacgtgagaagaagccccggctaacttcgtgccagcagccgcggtaatacgaagggggctagcgttgttcggaattactgggcgtaaagggcgcgtaggcggtccgctcagtcagaagtgaaagccccgggctcaacctgggaattgcttttgatactggtggacttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactaccggttccagagatgggactttcggttcggccgggtggaacacaggtgctgcatggctgtcgtcagctcgtgtcgtgagatgttgggttaagtcccgcaacgagcgcaacccccactgccagttgccatcattcagttgggcactctggtggaactgccggtgacaagccggaggaaggcggggatgacgtcaagtcctcatggcccttatgggttgggctacacacgtgctacaatggcggtgacagtgggacgcgaagccgcgaggtggagcaaatccccaaaagccgtctcagttcggatcgtactctgcaactcgagtgcgtgaagttggaatcgctagtaatcgcggatcagcacgccgcggtgaatacgttcccgggccttgtacacaccgcccgtcacaccatgggagttggctttacccgaaggtggtgcgctaacccgtaagggaggcagccaaccacggtaaggtcagcgactggggtgaagtcgtaacaaggtagccgtaggggaacctgcggctggatcacctcctttctaagg

SEQ ID NO: 1585 - DNA, 1504 bp, Azospirillum sp. M2T2B2
  ref <308>: DATABASE ACCESSION NUMBER: NCBI ACCESSION: NZ_CP029829.1
  ref <309>: DATABASE ENTRY DATE: 2019-04-01
  ref <313>: RELEVANT RESIDUES IN SEQ ID NO: (1)..(1504)
gaacctgagagtttgatcctggctcagaacgaacgctggcggcatgcctaacacatgcaagtcgaacgatggcttcggccatagtggcgcacgggtgagtaacacgtgggaacctgcctttcggttcggaataacgtctggaaacggacgctaacaccggatacgtcccccaaagagatttggcgggagaaagtttacgccgagagaggggcccgcgccggattaggtagttggtgtggtaacggcgcaccaagccgacgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcctgtttagtcagaagtgaaagccccgggctcaacctgggaacagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactatgagtgagagagatcacactcttcggttcggccgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggacgcgaagccgcgaggtggagcaaatccccaaaagccgtctcagttcggatcgtactctgcaactcgagtgcgtgaagttggaatcgctagtaatcgcggatcagcacgccgcggtgaatacgttcccgggccttgtacacaccgcccgtcacaccatgggagttggctttacccgaaggtggtgcgctaacccggcaacgggaggcagccaaccacggtaaggtcagcgactggggtgaagtcgtaacaaggtagccgtaggggaacctgcggctggatcacctcctttcta

SEQ ID NO: 1586 - DNA, 1490 bp, Azospirillum sp. RU37A
  ref <308>: DATABASE ACCESSION NUMBER: NCBI ACCESSION: NZ_FZOP01000057.1
  ref <309>: DATABASE ENTRY DATE: 2019-04-01
  ref <313>: RELEVANT RESIDUES IN SEQ ID NO: (1)..(1490)
aaacctgagagtttgatcctggctcagaacgaacgctggcggcaggcctaacacatgcaagtcgaacgcaccgcaaggtgagtggcgcacgggtgagtaacacgtgggaatgtatcctttggttcggaataacgtttggaaacgaacgctaataccggatgagccctacgggggaaagatttatcgccaaaggagcagcccgcgtctgattaggtagttggtggggtaatggcctaccaagccgacgatcagtagctggtctgagaggatgatcagccacactgggactgagacacggcccagactcctacgggaggcagcagtggggaatattggacaatgggcgcaagcctgatccagccatgccgcgtgagtgatgaaggccttcgggttgtaaagctctttcgcacacgacgatgatgacggtagtgtgagaagaagccccggctaacttcgtgccagcagccgcggtaatacgaagggggctagcgttgttcggaattactgggcgtaaagggcgcgtaggcggtttttcaagtcaggcgtgaaagccccgggcttaacctgggaactgcgcttgagactgtaagactagagtaccggagaggtgggtggaattcccagtgtagaggtgaaattcgtagatattgggaagaacaccggtggcgaaggcggcccactggacggtaactgacgctgaggcgcgaaagcgtggggagcaaacaggattagataccctggtagtccacgccgtaaacgatgtcggctagacgttggggctcttagagcttcagtgtcgcagctaacgcattaagccgaccgcctggggagtacggccgcaaggttgaaactcaaaggaattgacgggggcccgcacaagcggtggagcatgtggtttaattcgaagcaacgcgcagaaccttaccaacccttgacatgccttgaccgatgcagagatgcatctttcctttcggggacagggacacaggtgctgcatggctgtcgtcagctcgtgtcgtgagatgttgggttaagtcccgcaacgagcgcaacccccactgttagttgccagcatttagttgggcactctagcagaactgccggtgacaagccggaggaaggcggggatgacgtcaagtcctcatggcccttacgggttgggctacacacgtgctacaatggtggtgacagtgggcagcgaccacgcgagtggaagcgaatctccaaaagccatctcagttcggattgcactctgcaactcgggtgcatgaagttggaatcgctagtaatcgcggatcagcacgccgcggtgaatacgttcccgggccttgtacacaccgcccgtcacaccatgggagttggctttacctgaagccggtgcgctaaccgcaaggaggcagccgaccacggtacggtcagcgactggggtgaagtcgtaacaaggtagccgtaggggaacctgcggctggatcacctcctttctaaggaag

SEQ ID NO: 1587 - DNA, 1490 bp, Azospirillum sp. RU38E; identical to SEQ ID NO: 1586
  ref <308>: DATABASE ACCESSION NUMBER: NCBI ACCESSION: NZ_FZOI01000058.1
  ref <309>: DATABASE ENTRY DATE: 2019-04-01
  ref <313>: RELEVANT RESIDUES IN SEQ ID NO: (1)..(1490)

SEQ ID NO: 1588 - DNA, 1301 bp, Azospirillum sp. Sp 7
  ref <308>: DATABASE ACCESSION NUMBER: NCBI ACCESSION: NZ_LGRK01000127.1
  ref <309>: DATABASE ENTRY DATE: 2019-04-01
  ref <313>: RELEVANT RESIDUES IN SEQ ID NO: (1)..(1301)
gagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggcgagcgttgttcggaattactgggcgtaaagggcgcgtaggcggcccgatcagtcagatgtgaaagccccgggctcaacctgggaactgcatttgatactgtcgggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgctggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactaccggctcgagagatcgggctttcagttcggctgggtggaacacaggtgctgcatggctgtcgtcagctcgtgtcgtgagatgttgggttaagtcccgcaacgagcgcaacccctaccgccagttgccatcattcagttgggcactctggtggaactgccggtgacaagccggaggaaggcggggatgacgtcaagtcctcatggcccttatgggttgggctacacacgtgctacaatggcggtgacagtgggatgcgaagtcgcaagatggagccaatccccaaaagccgtctcagttcggattgcactctgcaactcgggtgcatgaagttggaatcgctagtaatcgcggatcagcacgccgcggtgaatacgttcccgggccttgtacacaccgcccgtcacaccatgggagttggctttacccgaaggtggtgcgctaaccggcaacggaggcagccaaccacggtcaggtcagcgactggggtgaagtcgtaacaaggtagccgtaggggaacctgcggctggatcacctcctttctaagg

SEQ ID NO: 1589 - DNA, 1492 bp, Azospirillum sp. TSA6c
  ref <308>: DATABASE ACCESSION NUMBER: NCBI ACCESSION: NZ_LGQS01000028.1
  ref <309>: DATABASE ENTRY DATE: 2019-04-01
  ref <313>: RELEVANT RESIDUES IN SEQ ID NO: (1)..(1492)
gaacctgagagtttgatcctggctcagaacgaacgctggcggcatgcctaacacatgcaagtcgaacgaaggcttcggccttagtggcgcacgggtgagtaacacgtgggaacctgcctttcggttcggaataacgtttggaaacgaacgctaacaccggatacgcccttcgggggaaagttcacgccgagagaggggcccgcgtcggattaggtagttggtgaggtaatggctcaccaagccttcgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcctgtttagtcagaagtgaaagccccgggctcaacctgggaatagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccattatgggcttcagagatgaggtccttcagttcggctgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggaagcgaagtcgcgagatggagcaaatccccaaaagccgtctcagttcggatcgcactctgcaactcgagtgcgtgaagttggaatcgctagtaatcgcggatcagcacgccgcggtgaatacgttcccgggccttgtacacaccgcccgtcacaccatgggagttggttttacccgaaggtggtgcgctaacccgcaagggaggcagccaaccacggtaaggtcagcgactggggtgaagtcgtaacaaggtagccgtaggggaacctgcggctggatcacctcctttctaagg

SEQ ID NO: 1590 - DNA, 1504 bp, Azospirillum sp. TSH58
  ref <308>: DATABASE ACCESSION NUMBER: NCBI ACCESSION: NZ_CP022364.1
  ref <309>: DATABASE ENTRY DATE: 2019-04-01
  ref <313>: RELEVANT RESIDUES IN SEQ ID NO: (1)..(1504)
gaacctgagagtttgatcctggctcagaacgaacgctggcggcatgcctaacacatgcaagtcgaacgaaggcttcggccttagtggcgcacgggtgagtaacacgtgggaacctgccttatggttcgggataacgtctggaaacggacgctaacaccggatgtgccccccagagagatttgggtggggaaagtttacgccatgagaggggcccgcgtccgattaggtagttggtggggtaatggcccaccaagccgacgatcggtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggcgagcgttgttcggaattactgggcgtaaagggcgcgtaggcggcctgtttagtcagaagtgaaagccccgggcttaacctgggaacggcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgctggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccattgccggtccgagagattggaccttcagttcggctggatggaacacaggtgctgcatggctgtcgtcagctcgtgtcgtgagatgttgggttaagtcccgcaacgagcgcaacccctaccgccagttgccatcattcagttgggcactctggtggaactgccggtgacaagccggaggaaggcggggatgacgtcaagtcctcatggcccttatgggttgggctacacacgtgctacaatggcggtgacagtgggatgcgaagtcgcaagatggagccaatccccaaaagccgtctcagttcggattgcactctgcaactcgggtgcatgaagttggaatcgctagtaatcgcggatcagcacgccgcggtgaatacgttcccgggccttgtacacaccgcccgtcacaccatgggagttggctttacccgaaggtggtgcgctaaccggcaacggaggcagccaaccacggtcaggtcagcgactggggtgaagtcgtaacaaggtagccgtaggggaacctgcggctggatcacctcctttctaagg

SEQ ID NO: 1591 - DNA, 1489 bp, Azospirillum sp. TSH64
  ref <308>: DATABASE ACCESSION NUMBER: NCBI ACCESSION: NZ_LGQW01000015.1
  ref <309>: DATABASE ENTRY DATE: 2019-04-01
  ref <313>: RELEVANT RESIDUES IN SEQ ID NO: (1)..(1489)
gaacctgagagtttgatcctggctcagaacgaacgctggcggcatgcctaacacatgcaagtcgaacgaaggcttcggccttagtggcgcacgggtgagtaacacgtgggaacctgcctttcggttcggaataacgtctggaaacggacgctaacaccggatacgccctatgggggaaagtttacgccgagagaggggcccgcgtcggattaggtagttggtgaggtaatggctcaccaagccttcgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcctgtttagtcagaagtgaaagccccgggctcaacctgggaatagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactaccggttcgagagatcggactttcagttcggctgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggacgcgaagtcgcgagatggagcaaatccccaaaagccgtctcagttcggatcgcactctgcaactcgagtgcgtgaagttggaatcgctagtaatcgcggatcagcacgccgcggtgaatacgttcccgggccttgtacacaccgcccgtcacaccatgggagttggttttacccgaaggtggtgcgctaaccgcaaggaggcagccaaccacggtaaggtcagcgactggggtgaagtcgtaacaaggtagccgtaggggaacctgcggctggatcacctcctttctaagg

SEQ ID NO: 1592 - DNA, 1491 bp, Azospirillum sp. TSO35-2
  ref <308>: DATABASE ACCESSION NUMBER: NCBI ACCESSION: NZ_LGRA01000021.1
  ref <309>: DATABASE ENTRY DATE: 2019-04-01
  ref <313>: RELEVANT RESIDUES IN SEQ ID NO: (1)..(1491)
gaacctgagagtttgatcctggctcagaacgaacgctggcggcatgcctaacacatgcaagtcgaacgaaggcttcggccttagtggcgcacgggtgagtaacacgtgggaacctgcctttcggttcgggataacgtctggaaacggacgctaacaccggatacgtccttcgggagaaagtttacgccgagagaggggcccgcgtcggattaggtagttggtgaggtaatggctcaccaagcctgcgatccgtagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggccctgtcagtcagaagtgaaagccccgggctcaacctgggaaccgcttttgatactgcagagcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactaccggttcgagagatcggactttcagttcggctgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggacgcgaagccgcgaggtggagcaaatccccaaaagccgtctcagttcggattgcactctgcaactcgagtgcatgaagttggaatcgctagtaatcgcggatcagcacgccgcggtgaatacgttcccgggccttgtacacaccgcccgtcacaccatgggagttggttttacccgaaggtggtgcgctaacccgcaagggaggcagccaaccacggtaaggtcagcgactggggtgaagtcgtaacaaggtagccgtaggggaacctgcggctggatcacctcctttctaagg

SEQ ID NO: 1593 - DNA, 1509 bp, Azospirillum thiophilum
  ref <308>: DATABASE ACCESSION NUMBER: NCBI ACCESSION: NZ_CP012405.1
  ref <309>: DATABASE ENTRY DATE: 2019-04-01
  ref <313>: RELEVANT RESIDUES IN SEQ ID NO: (1)..(1509)
tcggctgccgatctgaacctgagagtttgatcctggctcagaacgaacgctggcggcatgcctaacacatgcaagtcgaacgatggcttcggccatagtggcgcacgggtgagtaacacgtgggaacctgcctttcggttcggaataacgtttggaaacgaacgctaacaccggatacgcccttcgggggaaagttcacgccgagagaggggcccgcgtcggattaggtagttggtgaggtaatggctcaccaagccgacgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcccgatcagtcagaagtgaaagccccgggctcaacctgggaaccgcttttgatactgtcgggcttgagttccggagaggatggtggaattcccagtgtagaggtgaaattcgtagatattgggaagaacaccggtggcgaaggcggccatctggacggacactgacgctgaggcgcgaaagcgtggggagcaaacaggattagataccctggtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactaccggcaccagagatggtgctttcggttcggccgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggacgcgaagccgcgaggtggagcaaatccccaaaagccgtctcagttcggatcgtactctgcaactcgagtgcgtgaagttggaatcgctagtaatcgcggatcagcacgccgcggtgaatacgttcccgggccttgtacacaccgcccgtcacaccatgggagttggctttacccgaagacggtgcgctaaccagcaatggaggcagccggccacggtaaggtcagcgactggggtgaagtcgtaacaaggtagccgtaggggaacctgcggctggatcacctcctttctaaggaagc

SEQ ID NO: 1594 - DNA, 810 bp, Azotobacter beijerinckii
  ref <308>: DATABASE ACCESSION NUMBER: NCBI ACCESSION: NZ_FOSX01000169.1
  ref <309>: DATABASE ENTRY DATE: 2019-04-01
  ref <313>: RELEVANT RESIDUES IN SEQ ID NO: (1)..(810)
gactgatactgacactgaggtgcgaaagcgtggggagcaaacaggattagataccctggtagtccacgccgtaaacgatgtcgactagccgttgggctccttgagagcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttacctggccttgacatcctgcgaaccgggtagagatacctgggtgccttcgggagcgcagagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggccagggctacacacgtgctacaatggtcggtacagagggttgccaagtcgcgaggcggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctccttaatcgaaga

SEQ ID NO: 1595 - DNA, 1544 bp, Azotobacter chroococcum
  ref <308>: DATABASE ACCESSION NUMBER: NCBI ACCESSION: NZ_CP011835.1
  ref <309>: DATABASE ENTRY DATE: 2019-04-01
  ref <313>: RELEVANT RESIDUES IN SEQ ID NO: (1)..(1544)
gaactgaagagtttgatcatggctcagattgaacgctggcggcaggcctaacacatgcaagtcgagcggatgaggggtgcttgcatcccgattcagcggcggacgggtgagtaatgcctaggaatctgcccgatagtgggggacaacgtttcgaaaggaacgctaataccgcatacgtcctacgggagaaagtgggggctcttcggacctcacgctatcggatgagcctaggtcggattagctagttggtggggtaaaggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggctgtaagcgaataccttgcagttttgacgttaccgacagaataagcaccggctaacttcgtgccagcagccgcggtaatacgaagggtgcaagcgttaatcggaattactgggcgtaaagcgcgcgtaggtggtttggtaagttggatgtgaaagccccgggctcaacctgggaactgcatccaaaactgcctgactagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggctccttgagagcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacagagggttgccaagtcgcgaggcggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgctccagaagtagctagtctaaccttcgggaggacggttaccacggagtgattcatgactggggtgaagtcgtaacaaggtagccgtaggggaacctgcggctggatcacctccttaatcgaaga

SEQ ID NO: 1596 - DNA, 902 bp, Bacillaceae bacterium B16-10
  ref <308>: DATABASE ACCESSION NUMBER: NCBI ACCESSION: NZ_QOUX01000003.1
  ref <309>: DATABASE ENTRY DATE: 2019-04-01
  ref <313>: RELEVANT RESIDUES IN SEQ ID NO: (1)..(902)
acttgagtgcagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgacaaccctagagatagggctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggttgagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctatgga

SEQ ID NO: 1597 - DNA, 1553 bp, Bacillaceae bacterium EAG3
  ref <308>: DATABASE ACCESSION NUMBER: NCBI ACCESSION: NZ_PKOZ01000039.1
  ref <309>: DATABASE ENTRY DATE: 2019-04-01
  ref <313>: RELEVANT RESIDUES IN SEQ ID NO: (1)..(1553)
ggagagtttgatcctggctcaggacgaacgctggcggcgtgcctaatacatgcaagtcgagcgaatcagatgggagcttgctcccggatgattagcggcggacgggtgagtaacacgtgggcaacctgcccgtaagattgggataactccgggaaaccggtgctaataccgaatagtttctgacacctcatggtgtcagagggaaagttggcttcggctaacacttacggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtgccattcgaataggctggcaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggccttccccttcgggggacagagtgacaggtggtgcatggttgtcgtcagctcgtgtcgtgagatgttgggttaagtcccgcaacgagcgcaacccttgtccttagttgccagcattcagttgggcactctagggagactgccggtgacaaaccggaggaaggtggggatgacgtcaaatcatcatgccccttatgacctgggctacacacgtgctacaatgggtggtacaaagggcagcgagaccgcgaggttaagcaaatcccataaaaccactctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 1598 - DNA, 1558 bp, Bacillaceae bacterium MTCC 10057
  ref <308>: DATABASE ACCESSION NUMBER: NCBI ACCESSION: NZ_JWIQ02000005.1
  ref <309>: DATABASE ENTRY DATE: 2019-04-01
  ref <313>: RELEVANT RESIDUES IN SEQ ID NO: (1)..(1558)
ctttttggagagtttgatcctggctcaggacgaacgctggcggcgtgcctaatacatgcaagtcgagcggacggaagggagcttgctcccggaagtcagcggcggacgggtgagtaacacgtgggtaacctgcctgtaagactgggataactccgggaaaccggggctaataccggatagcttcttcctccgcatggaggaagaatgaaaggcggcctttggctgtcacttacagatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtaccggagtcactgccggtaccttgacggtacctgaccagaaagccacggctaactacgtgccagcagccgcggtaatacgtaggtggcaagcgttgtccggaattattgggcgtaaagcgcgcgcaggcggccttttaagtctgatgtgaaagcccacggctcaaccgtggagggtcattggaaactggaaggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacacctctggagacagagcgttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgcctaaggtggggcagatgattggggtgaagtcgtaacaaggtagccgtatcggaaggtgcggctggatcacctcctttctaa

SEQ ID NO: 1599 - DNA, 1561 bp, Bacillaceae bacterium SAOS 7
  ref <308>: DATABASE ACCESSION NUMBER: NCBI ACCESSION: NZ_NKQE01000051.1
  ref <309>: DATABASE ENTRY DATE: 2019-04-01
  ref <313>: RELEVANT RESIDUES IN SEQ ID NO: (1)..(1561)
tttatcggagagtttgatcctggctcaggacgaacgctggcggcgtgcctaatacatgcaagtcgagcggacttgaatagaagcttgcttctattcaagttagcggcggacgggtgagtaacacgtgggtaacctgcctgtaagactgggataactccgggaaaccggggctaataccggataacttctttctccgcatggagaaggattgaaagatggtttcggctatcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctggagacagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgcctaaggtgggacagatgattggggtgaagtcgtaacaaggtagccgtatcggaaggtgcggctggatcacctcctttctaa

SEQ ID NO: 1600 - DNA, 1482 bp, Bacillaceae bacterium SAS-127
  ref <308>: DATABASE ACCESSION NUMBER: NCBI ACCESSION: NZ_NKXN01000066.1
  ref <309>: DATABASE ENTRY DATE: 2019-04-01
  ref <313>: RELEVANT RESIDUES IN SEQ ID NO: (1)..(1482)
ggagcttgcttctattcaagttagcggcggacgggtgagtaacacgtgggtaacctgcctgtaagactgggataactccgggaaaccggggctaataccggataagttctttctccgcatggagaaggattgaaagatggtttcggctatcacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctggagacagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacccttacgggagccagccgcctaaggtgggacagatgattggggtgaagtcgtaacaaggtagccgtatcggaaggtgcggctggatcacctcctttctaa

SEQ ID NO: 1601 - DNA, 1342 bp, Bacilli bacterium
  ref <308>: DATABASE ACCESSION NUMBER: NCBI ACCESSION: NZ_QOWG01000099.1
  ref <309>: DATABASE ENTRY DATE: 2019-04-01
  ref <313>: RELEVANT RESIDUES IN SEQ ID NO: (1)..(1342)
cggcgtaagctgtcacttatagatgggcccgcggcgcattagctagttggtgaggtaaaggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtcaggtagtaactgacctgaccttgacggtacctaaccagaaagccacggctaactacgtgccagcagccgcggtaatacgtaggtggcaagcgttgtccggatttattgggcgtaaagcgctcgcaggcggtcttttaagtctgatgtgaaagcccacggcttaaccgtggagggtcattggaaactggaggacttgagtgcagaagaggagagtggaattccatgtgtagcggtgaaatgcgtagagatatggaggaacaccagtggcgaaggcgactctctggtctgtaactgacgctgaggagcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctttcgacctccctagagatagggatttcccttcggggacgaaagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggcagcgaaaccgcaaggtcaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttcta

SEQ ID NO: 1602 - DNA, 1571 bp, Bacilli bacterium VT-13-104
  ref <308>: DATABASE ACCESSION NUMBER: NCBI ACCESSION: NZ_LAZH01000066.1
  ref <309>: DATABASE ENTRY DATE: 2019-04-01
  ref <313>: RELEVANT RESIDUES IN SEQ ID NO: (1)..(1571)
ttttttggagagtttgatcttggctcaggacgaacgctggcggcgtgcctaatacatgcaagtcgagcgctggaagctaatttcatcccttcgggatgaaattagtggaaagagcggcggacgggtgagtaacacgtgggcaacctacctataagactgggataactcgcggaaacgtgagctaataccggataatactttttattgcataataaggagtttgaaaggcggcgtaagctgtcacttatagatgggcccgcggcgcattagctagttggtgaggtaaaggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtcaggtagtaactgacctgaccttgacggtacctaaccagaaagccacggctaactacgtgccagcagccgcggtaatacgtaggtggcaagcgttgtccggatttattgggcgtaaagcgctcgcaggcggtcttttaagtctgatgtgaaagcccacggcttaaccgtggagggtcattggaaactggaggacttgagtgcagaagaggagagtggaattccatgtgtagcggtgaaatgcgtagagatatggaggaacaccagtggcgaaggcgactctctggtctgtaactgacgctgaggagcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctttcgacctccctagagatagggatttcccttcggggacgaaagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggcagcgaaaccgcaaggtcaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 1603 - DNA, 1554 bp, Bacillus abyssalis
  ref <308>: DATABASE ACCESSION NUMBER: NCBI ACCESSION: NZ_KV917369.1
  ref <309>: DATABASE ENTRY DATE: 2019-04-01
  ref <313>: RELEVANT RESIDUES IN SEQ ID NO: (1)..(1554)
tcttcggagagtttgatcctggctcaggacgaacgctggcggcgtgcctaatacatgcaagtcgagcggacagatgggagcttgctccctgaagtcagcggcggacgggtgagtaacacgtgggcaacctgcctgtaagactgggataacttcgggaaaccggagctaataccggataacaccgaggaccacatggtccttggttgaaagatggcttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacggtacaaagagtcgcaagaccgcgaggtggagctaatctcataaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaaccgtaaggagccagccgcctaaggtggggtagatgattggggtgaagtcgtaacaaggtagccgtatcggaaggtgcggctggatcacctcctttctaa

SEQ ID NO: 1604 - DNA, 1558 bp, Bacillus acidicola
  ref <308>: DATABASE ACCESSION NUMBER: NCBI ACCESSION: NZ_KV440953.1
  ref <309>: DATABASE ENTRY DATE: 2019-04-01
  ref <313>: RELEVANT RESIDUES IN SEQ ID NO: (1)..(1558)
ttttttggagagtttgatcctggctcaggacgaacgctggcggcgtgcctaatacatgcaagtcgagcgaatcaattgggagcttgctcccttttggttagcggcggacgggtgagtaacacgtgggtaacctgcctgtaagactgggataactccgggaaaccggggctaataccggataacttcttcctccgcatggggggatattgaaagatggcttcggctatcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggagacttgagtgcagaagaggagagtggaattccacgtgtagcggtgaaatgcgtagatatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgaccttagttgccagcattcagttgggcactctagggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1605 - DNA, 252 bp, Bacillus acidiproducens
  ref <308>: DATABASE ACCESSION NUMBER: NCBI ACCESSION: NZ_KB893999.1
  ref <309>: DATABASE ENTRY DATE: 2019-04-01
  ref <313>: RELEVANT RESIDUES IN SEQ ID NO: (1)..(252)
tttatggagagtttgatcctggctcaggacgaacgctggcggcgtgcctaatacatgcaagtcgagcggactctttaaaagcttgcttttaaagagttagcggcggacgggtgagtaacacgtgggtaacctgcctgtaagactgggataactccgggaaaccggggctaataccggataagtttttccttcgcatggaggaaaaataaaagatggcttttgctatcacttacagatggacccgcggcgcat

SEQ ID NO: 1606 - DNA, 230 bp, Bacillus aidingensis
  ref <308>: DATABASE ACCESSION NUMBER: NCBI ACCESSION: NZ_AUCI01000021.1
  ref <309>: DATABASE ENTRY DATE: 2019-04-01
  ref <313>: RELEVANT RESIDUES IN SEQ ID NO: (1)..(230)
ttaatggagagtttgatcctggctcaggacgaacgctggcggcgtgcctaatacatgcaagtcgagcgcgggaagcaggcagcccctcttcggagggaatgcgtgtggaacgagcggcggacgggtgagtaacacgtgggcaacctgccctgaggtctgggataaccccgggaaaccggggctaataccggataggcccatcgaccgcctggtcgatgggtaaaagcggg

SEQ ID NO: 1607 - DNA, 1346 bp, Bacillus akibai
  ref <308>: DATABASE ACCESSION NUMBER: NCBI ACCESSION: NZ_BAZQ01000126.1
  ref <309>: DATABASE ENTRY DATE: 2019-04-01
  ref <313>: RELEVANT RESIDUES IN SEQ ID NO: (1)..(1346)
atggctccggctatcactacaggatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggatttcggttcgtaaagctctgttgttagggaagaacaagtgccgttcgaatagggcggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggacgacgtcaaatcatcatgccccttatgacctgggctacacacgtgctacaatggatggtacaaagagcagcaaaaccgcgaggtcgagccaatctcataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacccttttgggagctagccgcctaaggtgggacagatgattggggtgaagtcgtaacaaggtagccgtatcggaaggtgcggctggatcacctcctttcta

SEQ ID NO: 1608 - DNA, 1358 bp, Bacillus alcalophilus
  ref <308>: DATABASE ACCESSION NUMBER: NCBI ACCESSION: NZ_ALPT02000159.1
  ref <309>: DATABASE ENTRY DATE: 2019-04-01
  ref <313>: RELEVANT RESIDUES IN SEQ ID NO: (1)..(1358)
ttcttttgtaaaagatggctccggctatcactacgggatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaataggtcggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaatatcggggctcaaccccgaggggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctttgaccactctagagatagagctttccccttcgggggacaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaaaccgcgaggtcgagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1609 - DNA, 1558 bp, Bacillus alkalinitrilicus
  ref <308>: DATABASE ACCESSION NUMBER: NCBI ACCESSION: NZ_KV917368.1
  ref <309>: DATABASE ENTRY DATE: 2019-04-01
  ref <313>: RELEVANT RESIDUES IN SEQ ID NO: (1)..(1558)
atttattggagagtttgatcctggctcaggacgaacgctggcggcgtgcctaatacatgcaagtcgagcggacctttcaagagcttgctcttgaaaggttagcggcggacgggtgagtaacacgtgggcaacctgccctgtagactgggataacttcgggaaaccggagctaataccggataatcaatcacaccacatggtgtgattgtaaaagttgggtttacctaacactatgggatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggccttcgggtcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaagacttgagtacagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacggccgcaaggctgaaactcaaaggaattgacgggggcccgcacaagcggtggagcatgtggtttaattcgaagcaacgcgaagaaccttaccaggtcttgacatcccttgacacctctagagatagagcgttccccttcgggggacaaggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaaaccgcgaggtcgagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1610 - DNA, 306 bp, Bacillus alveayuensis
  ref <308>: DATABASE ACCESSION NUMBER: NCBI ACCESSION: NZ_JYCE01000167.1
  ref <309>: DATABASE ENTRY DATE: 2019-04-01
  ref <313>: RELEVANT RESIDUES IN SEQ ID NO: (1)..(306)
ttttttggagagtttgatcctggctcaggacgaacgctggcggcgtgcctaatacatgcaagtcgagcggaccgctaaggagcttgctctttggcggttagcggcggacgggtgagtaacacgtgggcaacctgccctgcagactgggataactccgggaaaccggggctaataccggataacaccgagaaccgcatggttcttggttgaaaggcggcttcggctgtcactgcaggatgggcccgcggcgcattagctagttggtgaggtaacggctcaccaaggcgacgatgcgtagccgacctg

SEQ ID NO: 1611 - DNA, 1463 bp, Bacillus anthracis
  ref <308>: DATABASE ACCESSION NUMBER: NCBI ACCESSION: NZ_FBXP01000069.1
  ref <309>: DATABASE ENTRY DATE: 2019-04-01
  ref <313>: RELEVANT RESIDUES IN SEQ ID NO: (1)..(1463)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttrccatcattwagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttt

SEQ ID NO: 1612 - DNA, 251 bp, Bacillus aurantiacus
  ref <308>: DATABASE ACCESSION NUMBER: NCBI ACCESSION: NZ_AUCJ01000012.1
  ref <309>: DATABASE ENTRY DATE: 2019-04-01
  ref <313>: RELEVANT RESIDUES IN SEQ ID NO: (1)..(251)
ttctatggagagtttgatcctggctcaggacgaacgctggcggcgtgcctaatacatgcaagtcgagcggactgatggggagcttgctcccctgacgtcagcggcggacgggtgagtaacacgtgggcaacctgcctcacagattgggataactccgggaaaccggggctaataccgaataatcaaaggaaccgcatggttcccttgtaaaagttgggttttacctaacactgtgagatgggcccgcggcg

SEQ ID NO: 1613 - DNA, 1058 bp, Bacillus australimaris
  ref <308>: DATABASE ACCESSION NUMBER: NCBI ACCESSION: NZ_LGYN01000018.1
  ref <309>: DATABASE ENTRY DATE: 2019-04-01
  ref <313>: RELEVANT RESIDUES IN SEQ ID NO: (1)..(1058)
ccatgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatc

SEQ ID NO: 1614 - DNA, 1554 bp, Bacillus azotoformans
  ref <308>: DATABASE ACCESSION NUMBER: NCBI ACCESSION: NZ_JJRY01000006.1
  ref <309>: DATABASE ENTRY DATE: 2019-04-01
  ref <313>: RELEVANT RESIDUES IN SEQ ID NO: (1)..(1554)
tttttggagagtttgatcctggctcaggacgaacgctggcggcgtgcctaatacatgcaagtcgagcggatgataaaggagcttgctcctttagattcagcggcggacgggtgagtaacacgtgggcaacctgcctgtaagactgggataacttcgggaaaccggagctaataccggataactcttcgaacttcatggttcgaagataaaagatggtttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtatcagttaactgctggtaccttgacggtacctaacgagaaagccacggctaactacgtgccagcagccgcggtaatacgtaggtggcaagcgttgtccggatttattgggcgtaaagcgcgcgcaggcggttctttaagtctgatgtgaaagcccccggctcaaccggggagggtcattggaaactggggaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggactttcccttcggggacagagtgacaggtggtgcatggttgtcgtcagctcgtgtcgtgagatgttgggttaagtcccgcaacgagcgcaacccttgtccttagttgccagcattcagttgggcactctaaggagactgccggtgacaaaccggaggaaggtggggatgacgtcaaatcatcatgccccttatgacctgggctacacacgtgctacaatggatggtacaaagggctgctaagccgcgaggcctgagccaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1615 - DNA, 1572 bp, Bacillus beveridgei
  ref <308>: DATABASE ACCESSION NUMBER: NCBI ACCESSION: NZ_CP012502.1
  ref <309>: DATABASE ENTRY DATE: 2019-04-01
  ref <313>: RELEVANT RESIDUES IN SEQ ID NO: (1)..(1572)
tttatcggagagtttgatcctggctcaggacgaacgctggcggcatgcctaatacatgcaagtcgagcgcaggaagctaacagaagccttcgggtggacgtcagtggaatgagcggcggacgggtgagtaacacgtgggcaacctgccctgcagaccgggacaacctcgtgaaaacgaggctaataccggatgaccgtaagtatcgcatggtacctacgtaaaagaggggattcgtcctctcactgcaggatgggcccgcggcgcattagctggttggtgaggtaagggctcaccaaggcgacgatgcgtagccgacctgagagggtgatcggccacactgggactgagacacggcccagactcctacgggaggcagcagtagggaatcatccgcaatgggcgaaagcctgacggtgcaatgccgcgtgaacgatgaaggttctcggatcgtaaagttctgttatgagggaagaacaagtgccgtttgaataaggcggcaccttgacggtacctcacgagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggggacttgagtgtaagagaggaaagtggaattccacgtgtagcggtgaaatgcgtagatatgtggaggaacaccagtggcgaaggcgactttctggcttacaactgacgctgaggcgcgaaagcgtggggagcaaacaggattagataccctggtagtccacgccgtaaacgatgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgaacatccaggagactgggttttccccttcgggggacagagtgacaggtggtgcatggttgtcgtcagctcgtgtcgtgagatgttgggttaagtcccgcaacgagcgcaacccctgatcttagttgccagcattcagttgggcactctaaggtgactgccggtgataaaccggaggaaggtggggatgacgtcaaatcatcatgccccttatgacctgggctacacacgtgctacaatggatggtacaatgggtcgcgaagccgcgaggtggagccaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaaccttagggagccagccgccgaaggtgggacagatgattggggtgaagtcgtaacaaggtatccgtaccggaaggtgcggatggatcacctcctttctaa

SEQ ID NO: 1616 - DNA, 1531 bp, Bacillus bogoriensis
  ref <308>: DATABASE ACCESSION NUMBER: NCBI ACCESSION: NZ_JHYI01000050.1
  ref <309>: DATABASE ENTRY DATE: 2019-04-01
  ref <313>: RELEVANT RESIDUES IN SEQ ID NO: (1)..(1531)
tataaagttttaatgaagagtttgatcctggctcaggatgaacgctgacagaatgcttaacacatgcaagtctacttgaattcacttcggtgatagtaaggtggcggacgggtgagtaacacgtaaagaacttgccttgtagtctgggacaactattggaaacgatagctaataccggatattatgattttatcgcatgataagattatgaaagctatatgcgctacgagagagctttgcgtcccattagctagttggtgaggtaacggctcaccaaggcgacgatgggtagccggcctgagagggtgaacggccacaaggggactgagacacggcccttactcctacgggaggcagcagtggggaatattggacaatggaccaaaagtctgatccagcaattctgtgtgcacgatgacggtcttaggattgtaaagtgctttcaattgggaagaaacaaatgacggtaccaatagaagaagcgacggctaaatacgtgccagcagccgcggtaatacgtatgtcgcaagcgttatccggatttattgggcgtaaagcgcgtctaggtggtttggtaagtctgatgtgaaaatgcggggctcaactccgtattgcgttggaaactgcctaactagagtatcggagaggtgggcggaactacaagtgtagaggtgaaattcgtagatatttgtaggaatgccgatagagaagtcagctcactggacgaatactgacactgaagcgcgaaagcatggggagcaaacaggattagataccctggtagtccatgctgtaaacgatgattactaagcgtcgggggtcgaacctcggcactcaagctaacgcgataagtaatccgcctggggagtacgtacgcaagtatgaaactcaaaggaattgacgggggcccgcacaagcggtggagcatgtggtttaattcgacgcaacgcgaggaaccttaccagcgtttgacatcctaggaatgagaaagagatttcttagtgctccttcgggagaacctagagacaggtggtgcatggctgtcgtcagctcgtgtcgtgagatgttgggttaagtcccgcaacgagcgcaacccctattgtatgttgccatcattaagttgggcactcatgcgatactgcctgcgatgagcaggaggaaggtggggatgacgtcaaatcatcatgccccttatgacctgggctacacacgtgctacaatgggcagtacagagagaagcaatttcgcgagaaggagcaaatctcagaaagctgttcgtagttcggattgtactctgcaactcgagtacatgaagttggaatcactagtaatcgcaaatcagctatgttgcggtgaatacgttctcgggtcttgtacacaccgcccgtcacaccacgagagtttgtaacacccgaagtcggtggggtaaccttttggagccagccgcctaaggtgggacagatgattggggtgaagtcgtaacaaggtatccgtacgggaacgtgcggatggatcacctcctttctaagga

SEQ ID NO: 1617 - DNA, 1556 bp, Bacillus bombysepticus; identical to SEQ ID NO: 120
  ref <308>: DATABASE ACCESSION NUMBER: NCBI ACCESSION: NZ_CP007512.1
  ref <309>: DATABASE ENTRY DATE: 2019-04-01
  ref <313>: RELEVANT RESIDUES IN SEQ ID NO: (1)..(1556)

SEQ ID NO: 1618 - DNA, 1556 bp, Bacillus boroniphilus
  ref <308>: DATABASE ACCESSION NUMBER: NCBI ACCESSION: NZ_BBCO01000204.1
  ref <309>: DATABASE ENTRY DATE: 2019-04-01
  ref <313>: RELEVANT RESIDUES IN SEQ ID NO: (1)..(1556)
tttcttggagagtttgatcctggctcaggacgaacgctggcggcgtgcctaatacatgcaagtcgagcggatcttcattagcttgcttttgaagatcagcggcggacgggtgagtaacacgtgggcaacctgcctgtaagactgggataacttcgggaaaccggagctaataccggataatcctttccctcacatgagggaaagctgaaagacggtttcggctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgtcagggaagaacaagtgccggagtaactgccggtaccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggtcgcgaagccgcgaggtcgagccaatcccataaatccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttctaa

SEQ ID NO: 1619 - DNA, 676 bp, Bacillus campisalis
  ref <308>: DATABASE ACCESSION NUMBER: NCBI ACCESSION: NZ_LAYY01000014.1
  ref <309>: DATABASE ENTRY DATE: 2019-04-01
  ref <313>: RELEVANT RESIDUES IN SEQ ID NO: (1)..(676)
ttattggagagtttgatcctggctcaggacgaacgctggcggcgtgcctaatacatgcaagtcgagcggacttgagggagcttgctcccgatggtcagcggcggacgggtgagtaacacgtgggcaacctgcctgtaagactgggataactccgggaaaccggggctaataccggataattcattccctcacatgagggaatactgaaagacggctccggctgtcacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtgccggagtaactgccggcaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaga

SEQ ID NO: 1620 - DNA, 1258 bp, Bacillus cecembensis
  ref <308>: DATABASE ACCESSION NUMBER: NCBI ACCESSION: NZ_LMBZ01000051.1
  ref <309>: DATABASE ENTRY DATE: 2019-04-01
  ref <313>: RELEVANT RESIDUES IN SEQ ID NO: (1)..(1258)
tcactacaggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggatttcggttcgtaaaactctgttgcaagggaagaacaagtagcgtagtaactggcgctaccttgacggtaccttgttagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggaaacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccattgaccactgtagagatacagttttcccttcggggacaacggtgacaggtggtgcatggttgtcgtcagctcgtgtcgtgagatgttgggttaagtcccgcaacgagcgcaacccttattcttagttgccatcatttagttgggcactctaaggagactgccggtgacaaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacctttatggagccagccgccgaaggt

SEQ ID NO: 1621 - DNA, 1557 bp, Bacillus cihuensis
  ref <308>: DATABASE ACCESSION NUMBER: NCBI ACCESSION: NZ_AYSD01000010.1
  ref <309>: DATABASE ENTRY DATE: 2019-04-01
  ref <313>: RELEVANT RESIDUES IN SEQ ID NO: (1)..(1557)
tttttggaaagtttgatcctggctcaggacgaacgctggcggcgtgcctaatacatgcaagtcgggcgaatgattgggagcttgctcccatgatttagcggcgggcgggtgagtaccacgtgggtaacctacctgtaagactgggataacttcgggaaaccggagctaataccggataatttcttttctcgcatgagaagagacggaaagacggtttcggctgtcacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccggggagggtcattggaaactggggaacttgagtgcagaagaggaaagtggaattccacgtgtagcggtgaaatgcgtagagatgtggaggaacaccagtggcgaaggcgattttctggtctgtaactgacactgaggcgcgaaagcgtggggagcgaacaggattagataccctggtagtctacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctagagagataggacgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagagctgcgaacccgcgagggtaagcgaatctcataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctctaaggagccagccgcctaaggtgggacagatgattggggtgaagtcgtaacaaggtagccgtatcggaaggtgcggctggatcacctcctttctaa

SEQ ID NO: 1622 - DNA, 1159 bp, Bacillus coagulans
  ref <308>: DATABASE ACCESSION NUMBER: NCBI ACCESSION: NZ_FQUB01000001.1
  ref <309>: DATABASE ENTRY DATE: 2019-04-01
  ref <313>: RELEVANT RESIDUES IN SEQ ID NO: (1)..(1159)
gcttgcttttaaaaggttagcggcggacgggtgagtaacacgtgggcaacctgcctgtaagactgggataacgccgggaaaccggggctaataccagatagttttttcctccgcatggaggaaaaaggaaaggcggcttcggctgccacttacagatgggcccgcggcgcattagctagttggcggggtaacggcccaccaaggcaacgatgcgtagccgacctgagagggtgatcggccacattgggactgagacacggcccaaactcctacgggaggcagcagtagggaatcttccgcaatggacgaaagtctgacggagcaacgccgcgtgagtgaagaaggccttcgggtcgtaaaactctgttgccggggaagaacaagtgccgttcgaacagggcggcgccttgacggtacccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacctccctggagacagggccttccccttcgggggacagagtgacaggtggtgcatggttgtcgtcagctcgtgtcgtgagatgttgggttaagtcccgcaacgagcgcaacccttgaccttagttgccagcattgagttgggcactctaaggtgactgccggtgacaaaccggaggaaggtggggatgacgtcaaatcatcatgccccttatgacctgggctacac

SEQ ID NO: 1623 - DNA, 319 bp, Bacillus coahuilensis
  ref <308>: DATABASE ACCESSION NUMBER: NCBI ACCESSION: NZ_LDYG01000048.1
  ref <309>: DATABASE ENTRY DATE: 2019-04-01
  ref <313>: RELEVANT RESIDUES IN SEQ ID NO: (1)..(319)
tttatggagagtttgatcctggctcaggacgaacgctggcggcgtgcctaatacatgcaagtcgagcgaggcctttgggcctagcggcggacgggtgagtaacacgtgggtaacctgcctgtaagactgggataacttcgggaaaccgaagctaataccggataacatttttggttgcatgaccgaaaattgaaaggtggcttttagctatcacttacagatggacccgcggcgcattagctagttggtgaggtaacggctcaccaaggcaacgatgcgtagccgacctgagagggtgatcggccacactgggactgag

SEQ ID NO: 1624 - DNA, 1555 bp, Bacillus dakarensis
  ref <308>: DATABASE ACCESSION NUMBER: NCBI ACCESSION: NZ_LT707408.1
  ref <309>: DATABASE ENTRY DATE: 2019-04-01
  ref <313>: RELEVANT RESIDUES IN SEQ ID NO: (1)..(1555)
ttttttggagagtttgatcctggctcaggacgaacgctggcggcgtgcctaatacatgcaagtcgagcggacttttaaaagcttgcttttaaaagttagcggcggacgggtgagtaacacgtgggcaacctgcctgtaagactgggataacttcgggaaaccggagctaataccggataatgtttctcctctcatgaggagaaactgaaagatggtttacgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1625 - DNA, 1335 bp, Bacillus dielmoensis
  ref <308>: DATABASE ACCESSION NUMBER: NCBI ACCESSION: NZ_HG942011.1
  ref <309>: DATABASE ENTRY DATE: 2019-04-01
  ref <313>: RELEVANT RESIDUES IN SEQ ID NO: (1)..(1335)
gctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggactttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttctaa

SEQ ID NO: 1626 - DNA, 1604 bp, Bacillus drentensis
  ref <308>: DATABASE ACCESSION NUMBER: NCBI ACCESSION: NZ_KV440952.1
  ref <309>: DATABASE ENTRY DATE: 2019-04-01
  ref <313>: RELEVANT RESIDUES IN SEQ ID NO: (1)..(1604)
tttcttggagagtttgatcctggctcaggacgaacgctggcggcgtgcctaatacatgcaagtcgagcgaatcaataggagcttgctcctgttggttagcggcggacgggtgagtaacacgtgggcaacctgcctgtaagactgggataacaccgggaaaccggtgctaataccggataatccttttcctctcatgaggaaaagctgaaagtcggtttcggctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacctgggacaaaacttaacctcttattataatgataggaagttaagttttgtcctaggagccagccgcctaaggtgggacagatgattggggtgaagtcgtaacaaggtagccgtatcggaaggtgcggctggatcacctcctttctaa

SEQ ID NO: 1627 - DNA, 1556 bp, Bacillus eiseniae
  ref <308>: DATABASE ACCESSION NUMBER: NCBI ACCESSION: NZ_KV440946.1
  ref <309>: DATABASE ENTRY DATE: 2019-04-01
  ref <313>: RELEVANT RESIDUES IN SEQ ID NO: (1)..(1556)
ctttattggagagtttgatcctggctcaggacgaacgctggcggcgtgcctaatacatgcaagtcgagcgaatctttgggagcttgctcccaaagattagcggcggacgggtgagtaacacgtgggcaacctgcctgtaagactgggataacttcgggaaaccggagctaataccggataatccctttcctcacatgaggaaaggctgaaagacggcgtctagctgtcacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcgaacaggattagataccctggtagtccacgccgtaaacgatgagtgctaagtgttagagggtttccgccctttagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctctgacaatcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1628 - DNA, 239 bp, Bacillus enclensis
  ref <308>: DATABASE ACCESSION NUMBER: NCBI ACCESSION: NZ_FMAU01000010.1
  ref <309>: DATABASE ENTRY DATE: 2019-04-01
  ref <313>: RELEVANT RESIDUES IN SEQ ID NO: (1)..(239)
ttttatcggagagtttgatcctggctcaggacgaacgctggcggcgtgcctaatacatgcaagtcgagcggatcaatgggagcttgctccctgagatcagcggcggacgggtgagtaacacgtgggtaacctgcctgtaagactgggataactccgggaaaccggggctaataccggataatttagttcctcgcatgaggaactgttgaaaggtggcttttcgctaccacttacagatg

SEQ ID NO: 1629 - DNA, 1077 bp, Bacillus farraginis
  ref <308>: DATABASE ACCESSION NUMBER: NCBI ACCESSION: NZ_LMCA01000084.1
  ref <309>: DATABASE ENTRY DATE: 2019-04-01
  ref <313>: RELEVANT RESIDUES IN SEQ ID NO: (1)..(1077)
cggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaatcttgcggctcaaccgcaagcggccattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctcttgacctccctagagatagggatttcccttcggggacaggagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1630 - DNA, 1316 bp, Bacillus fastidiosus
  ref <308>: DATABASE ACCESSION NUMBER: NCBI ACCESSION: NZ_BCVG01000225.1
  ref <309>: DATABASE ENTRY DATE: 2019-04-01
  ref <313>: RELEVANT RESIDUES IN SEQ ID NO: (1)..(1316)
cccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggaaacttgagtgcagaagaggaaagtggaattccacgtgtagcggtgaaatgcgtagagatgtggaggaacaccagtggcgaaggcgactttctggtctgtaactgacgctgaggcgcgaaagcatggggagcgaacaggattagataccctggtagtccatgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccactcctagagataggacgtttcccttcggggaacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagactgcgaagtcaagcgaatcccataaaaccattctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1631 - DNA, 1082 bp, Bacillus filamentosus
  ref <308>: DATABASE ACCESSION NUMBER: NCBI ACCESSION: NZ_FXAJ01000025.1
  ref <309>: DATABASE ENTRY DATE: 2019-04-01
  ref <313>: RELEVANT RESIDUES IN SEQ ID NO: (1)..(1082)
aataagcaggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacggggacccgcacaagcggtggagcatgtggtttaattcgaagcaacgcgaagaaccttaccaggtcttgacatcctctgctacttctagagatagaaggttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgtgaggtcgagccaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1632 - DNA, 236 bp, Bacillus fordii
  ref <308>: DATABASE ACCESSION NUMBER: NCBI ACCESSION: NZ_KB894687.1
  ref <309>: DATABASE ENTRY DATE: 2019-04-01
  ref <313>: RELEVANT RESIDUES IN SEQ ID NO: (1)..(236)
ttatacgagagtttgatcctggctcaggacgaacgctggcggcgtgcctaatacatgcaagtcgagcggatgaaagagagcttgctctctggattcagcggcggacgggtgagtaacacgtgggcaacctgcctgtaagactgggataactccgggaaaccggggctaataccggataacttcttttcccgcatggggagaggttgaaagacggttatgctgtcacttacagatgg

SEQ ID NO: 1633 - DNA, 1556 bp, Bacillus fumarioli
  ref <308>: DATABASE ACCESSION NUMBER: NCBI ACCESSION: NZ_BCUZ01000224.1
  ref <309>: DATABASE ENTRY DATE: 2019-04-01
  ref <313>: RELEVANT RESIDUES IN SEQ ID NO: (1)..(1556)
tttcttggagagtttgatcctggctcaggacgaacgctggcggcgtgcctaatacatgcaagtcgagcgaatctttaaggggcttgccccttgagattagcggcggacgggtgagtaacacgtgggcaacctgcctgtaagaccgggataacttcgggaaaccggagctaataccggatcatcctttccttcgcatgaaggaaagctgaaagacggcgtaagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccctgacactcctagagataggaatttccccttcgggggacagggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtggagccaatcccacaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 1634 - DNA, 1556 bp, Bacillus gaemokensis
  ref <308>: DATABASE ACCESSION NUMBER: NCBI ACCESSION: NZ_LTAQ01000012.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataatatttttcactgcatagtgraaaattgaaaggcggcttcggctgtcacttatggatggacccgcgtcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaaaaccctagagatagggcttccccttcgggggcaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 1635 - DNA, 1554 bp, Bacillus galactosidilyticus
  ref <308>: DATABASE ACCESSION NUMBER: NCBI ACCESSION: NZ_LDJR01000010.1
  ref <309>: DATABASE ENTRY DATE: 2019-04-01
  ref <313>: RELEVANT RESIDUES IN SEQ ID NO: (1)..(1554)
ttatatgagagtttgatcctggctcaggacgaacgctggcggcgtgcctaatacatgcaagtcgagcgaatttgatgggagcttgctccctgaaaattagcggcggacgggtgagtaacacgtgggcaacctacctgtaagcctgggataacttcgggaaaccggagctaataccggataatttctttcttcacatgaagagaggttgaaagacggctttgctgtcacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgaagaaggtcttcggatcgtaaaactctgttatcagggaagaacaagtaccggagttactgccggtaccttgacggtacctgaccagaaagccacggctaactacgtgccagcagccgcggtaatacgtaggtggcaagcgttgtccggaattattgggcgtaaagcgcgcgcaggcggttctttaagtctgatgtgaaatcttgcggctcaaccgtgagcggtcattggaaactggagaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttatgcctgccctagagatagggagttcccttcggggacataagtgacaggtggtgcatggttgtcgtcagctcgtgtcgtgagatgttgggttaagtcccgcaacgagcgcaacccttgaaattagttgccagcatttagttgggcactctaatttgactgccggtgacaaaccggaggaaggtggggatgacgtcaaatcatcatgccccttatgacctgggctacacacgtgctacaatggatggtacagagggctgcgagaccgcgaggtttagccaatcccttaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttcta

SEQ ID NO: 1636 - DNA, 1556 bp, Bacillus gibsonii
  ref <308>: DATABASE ACCESSION NUMBER: NCBI ACCESSION: NZ_CP017070.1
  ref <309>: DATABASE ENTRY DATE: 2019-04-01
  ref <313>: RELEVANT RESIDUES IN SEQ ID NO: (1)..(1556)
atttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1637 - DNA, 1527 bp, Bacillus ginsengihumi
  ref <308>: DATABASE ACCESSION NUMBER: NCBI ACCESSION: NZ_JRUN01000121.1
  ref <309>: DATABASE ENTRY DATE: 2019-04-01
  ref <313>: RELEVANT RESIDUES IN SEQ ID NO: (1)..(1527)
gaacgctggcggcgtgcctaatacatgcaagtcgagcgaactgatgaagagcttgcttttgatcagttagcggcggacgggtgagtaacacgtgggtaacctgcctgtaagactaggataactccgggaaaccggggctaatactggataacttttctctccgcatggagagagattgaaagatggcttcggctatcacttacagatggacccgcggcgcattagctagttggtgaggtaacggctcaccaaggcaacgatgcgtagccgacctgagagggtgatcggccacattgggactgagacacggcccaaactcctacgggaggcagcagtagggaatcttccgcaatggacgaaagtctgacggagcaacgccgcgtgagtgaagaaggtcttcggatcgtaaaactctgttgttagggaagaacaagtatcgttcgaatagggcggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctctgacctccctagagatagggccttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1638 - DNA, 1555 bp, Bacillus gottheilii
  ref <308>: DATABASE ACCESSION NUMBER: NCBI ACCESSION: NZ_LT800494.1
  ref <309>: DATABASE ENTRY DATE: 2019-04-01
  ref <313>: RELEVANT RESIDUES IN SEQ ID NO: (1)..(1555)
tttcttggagagtttgatcctggctcaggacgaacgctggcggcgtgcctaatacatgcaagtcgagcggacggatgggagcttgctccctgaagtcagcggcggacgggtgagtaacacgtgggcaacctgcctgtaagactgggataacttcgggaaaccggagctaataccggataatgcttttggactcatgtccttaagctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1639 - DNA, 1556 bp, Bacillus halmapalus
  ref <308>: DATABASE ACCESSION NUMBER: NCBI ACCESSION: NZ_KV917375.1
  ref <309>: DATABASE ENTRY DATE: 2019-04-01
  ref <313>: RELEVANT RESIDUES IN SEQ ID NO: (1)..(1556)
ctttattggagagtttgatcctggctcaggacgaacgctggcggcgtgcctaatacatgcaagtcgagcggacttacaaaagcttgcttttgtaagttagcggcggacgggtgagtaacacgtgggcaacctgcccttaagactgggataacttcgggaaaccggagctaataccggataatataaagaacctcctggttctttattgaaagatggtttcggctatcgcttatggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgatgaaggccttcgggtcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagcaaaaccgcgaggtcgagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1640 - DNA, 1555 bp, Bacillus halodurans
  ref <308>: DATABASE ACCESSION NUMBER: NCBI ACCESSION: NC_002570.2
  ref <309>: DATABASE ENTRY DATE: 2019-04-01
  ref <313>: RELEVANT RESIDUES IN SEQ ID NO: (1)..(1555)
ttttatggagagtttgatcctggctcaggacgaacgctggcggcgtgcctaatacatgcaagtcgagcggaccaaagggagcttgctcctagaggttagcggcgaacgggtgagtaacacgtgggcaacctgcctgtaagactgggataacatcgagaaatcggtgctaatactggataataaaaagaactgcatggttcttttttgaaagatggtttcggctatcacttacagatgggcccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccgttcgaaagggcggcaccttgacggtacctaacgagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtacagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgacgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggttgcgaagccgcgaggtgaagccaatcccagaaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 1641 - DNA, 1557 bp, Bacillus halosaccharovorans
  ref <308>: DATABASE ACCESSION NUMBER: NCBI ACCESSION: NZ_KV917371.1
  ref <309>: DATABASE ENTRY DATE: 2019-04-01
  ref <313>: RELEVANT RESIDUES IN SEQ ID NO: (1)..(1557)
ctttattggagagtttgatcctggctcaggacgaacgctggcggcgtgcctaatacatgcaagtcgagcgaatctgagggagcttgctcccaaagattagcggcggacgggtgagtaacacgtgggtaacctgcctgtaagattgggataactccgggaaaccggagctaataccggataacattttgaaccgcatggttcaaaattgaaagacggcctttggctgtcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatccttcgctacttctagagatagaaggttccccttcgggggacgaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagactgcgaagtcaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 1642 - DNA, 1556 bp, Bacillus hemicellulosilyticus
  ref <308>: DATABASE ACCESSION NUMBER: NCBI ACCESSION: NZ_BAZO01000088.1
  ref <309>: DATABASE ENTRY DATE: 2019-04-01
  ref <313>: RELEVANT RESIDUES IN SEQ ID NO: (1)..(1556)
ttttatggagagtttgatcctggctcaggacgaacgctggcggcgtgcctaatacatgcaagtcgagcggacagaagggagcttgctcccggaagttagcggcgaacgggtgagtaacacgtgggcaacctgccctgtagattgggataacatcgagaaatcggtgctaataccggatgatagaatgagcgtgcatgcgtttattctcaaagatggcttcggctatcactacaggatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaagggtttcggctcgtaaagctctgttgttagggaagaacaagtgctagtcgaataggatggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactgggagacttgagtacagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccactctagagatagagctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1643 - DNA, 735 bp, Bacillus humi
  ref <308>: DATABASE ACCESSION NUMBER: NCBI ACCESSION: NZ_LMBW01000063.1
  ref <309>: DATABASE ENTRY DATE: 2019-04-01
  ref <313>: RELEVANT RESIDUES IN SEQ ID NO: (1)..(735)
caccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtatcgttcgaatagggcggtaccttgacggtacctaaccagaaagccacggctaactacgtgccagcagccgcggtaatacgtaggtggcaagcgttatccggaattattgggcgtaaagcgcgcgcaggcggtctcttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctt

SEQ ID NO: 1644 - DNA, 1337 bp, Bacillus jeddahensis
  ref <308>: DATABASE ACCESSION NUMBER: NCBI ACCESSION: NZ_CCAS010000137.1
  ref <309>: DATABASE ENTRY DATE: 2019-04-01
  ref <313>: RELEVANT RESIDUES IN SEQ ID NO: (1)..(1337)
gctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttatgccttccctagagatagggctttccccttcgggggacgtaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaagtcgcaagacctagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 1645 - DNA, 1555 bp, Bacillus jeotgali
  ref <308>: DATABASE ACCESSION NUMBER: NCBI ACCESSION: NZ_FVZC01000009.1
  ref <309>: DATABASE ENTRY DATE: 2019-04-01
  ref <313>: RELEVANT RESIDUES IN SEQ ID NO: (1)..(1555)
ttttttggagagtttgatcctggctcaggacgaacgctggcggcgtgcctaatacatgcaagtcgagcggatcttcattagcttgcttttgaagatcagcggcggacgggtgagtaacacgtgggcaacctgcctgtaagactgggataacttcgggaaaccggagctaataccggataatcctttccctcacatgagggaaagctgaaagacggtttcggctgtcacttacagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggctttcgggtcgtaaagttctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggtcgcgaagccgcgaggtgaagccaatcccataaatccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1646 - DNA, 1557 bp, Bacillus koreensis
  ref <308>: DATABASE ACCESSION NUMBER: NCBI ACCESSION: NZ_LILC01000014.1
  ref <309>: DATABASE ENTRY DATE: 2019-04-01
  ref <313>: RELEVANT RESIDUES IN SEQ ID NO: (1)..(1557)
tcggagagtttgatcctggctcaggacgaacgctggcggcgtgcctaatacatgcaagtcgagcggacttgttagaagcttgcttctaacaagttagcggcggacgggtgagtaacacgtgggtaacctgcctgtaagatggggataactccgggaaaccggagctaataccgaataacactttcgctcgcatgagcggatgttaaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatgagagtaactgctcgtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttccccttcgggggacaaagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatgatacaaagggttgcgaagccgcgaggtgaagctaatctcataaaatcattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaaggaa

SEQ ID NO: 1647 - DNA, 1460 bp, Bacillus korlensis
  ref <308>: DATABASE ACCESSION NUMBER: NCBI ACCESSION: NZ_BCVH01000052.1
  ref <309>: DATABASE ENTRY DATE: 2019-04-01
  ref <313>: RELEVANT RESIDUES IN SEQ ID NO: (1)..(1460)
agcggcggacgggtgagtaacacgtgggcaacctgcctatgagactgggataactccgggaaaccggggctaataccggataattcttttctactcatgtagagaagttgaaagatggtttcggctatcactcatagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggtggtctcttaagtctgatgtgaaagcccccggctcaaccggggagggtcattggaaactgggagacttgagtgcaggagagaagagtggaattccacgtgtagcggtgaaatgcgtagagatgtggaggaacaccagtggcgaaggcgactctttggcctgtaactgacactgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggtggtacaaagggcagcaaaaccgcgaggtcgagccaatcccataaaaccactctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaactcgcaagagagccagccgcctaaggtgggacagatgattggggtgaagtcgtaacaaggtagccgtatcggaaggtgcggctggatcacctcctttctaa

SEQ ID NO: 1648 - DNA, 267 bp, Bacillus kribbensis
  ref <308>: DATABASE ACCESSION NUMBER: NCBI ACCESSION: NZ_AUMQ01000034.1
  ref <309>: DATABASE ENTRY DATE: 2019-04-01
  ref <313>: RELEVANT RESIDUES IN SEQ ID NO: (1)..(267)
ggagagtttgatcctggctcaggacgaacgctggcggcgtgcctaatacatgcaagtcgagcggatcgatggaagcttgcttcctgagatcagcggcggacgggtgagtaacacgtgggcaacctgcccctaagatcgggataacttcgggaaaccggagctaataccggatatgacttttcttcacatgaagggaagtggaaagacggtttcggctgtcacttagggatgggcccgcggcgcattagctagttggtgaggtaacgg

SEQ ID NO: 1649 - DNA, 1561 bp, Bacillus krulwichiae
  ref <308>: DATABASE ACCESSION NUMBER: NCBI ACCESSION: NZ_CP020814.1
  ref <309>: DATABASE ENTRY DATE: 2019-04-01
  ref <313>: RELEVANT RESIDUES IN SEQ ID NO: (1)..(1561)
ttttatggagagtttgatcctggctcaggacgaacgctggcggcgtgcctaatacatgcaagtcgagcggactgaattaagagcttgctcttaattcagttagcggcggacgggtgagtaacacgtgggcaacctgccctgtagactgggataacatcgagaaatcggtgctaataccggataatatctgagacctcatggtcttagactaaaagatggctccggctatcactgcaggatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggatttcggttcgtaaagctctgttgttagggaagaacaagtatcgttcgaatagggcggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatccttatgccctccctagagatagggatttcccttcggggacataagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagagcagcaaaaccgcgaggtcgagccaatctcataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggagtaacccttttgggagctagccgcctaaggtgggacagatgattggggtgaagtcgtaacaaggtagccgtatcggaaggtgcggctggatcacctcctttcta

SEQ ID NO: 1650 - DNA, 1554 bp, Bacillus lehensis
  ref <308>: DATABASE ACCESSION NUMBER: NCBI ACCESSION: NZ_CP003923.1
  ref <309>: DATABASE ENTRY DATE: 2019-04-01
  ref <313>: RELEVANT RESIDUES IN SEQ ID NO: (1)..(1554)
ttttaacggagagtttgatcctggctcaggacgaacgctggcggcgtgcctaatacatgcaagtcgagcggacagaagggagcttgctcccggacgttagcggcggacgggtgagtaacacgtaggtaacctgccccttagactgggataactcccgggaaaccggagctaatacgggataataaagagaatcacctgattctcttttgaaagacggtttcggctgtcactaagggatgggcctgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgtgagggaagaacaagtaccggggtaactaccggtaccttgacggtacctcaccagaaagccacggctaactacgtgccagcagccgcggtaatacgtaggtggcaagcgttgtccggaattattgggcgtaaagcgcgcgcaggcggcttcttaagtctgatgtgaaatctcggggctcaaccccgagcggccattggaaactgggaagcttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagtaaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggacgacgtcaaatcatcatgccccttatgacctgggctacacacgtgctacaatggatggtacaaagggcagcgaaaccgcgaggtggagccaatcccataaagccattctcagttcggattgtaggctgcaactcgcctacatgaagccggaattgctagtaatcgcggatcagcatgccgcggtgaatacgttcccgggtcttgtacacaccgcccgtcacaccacgagagtttgtaacacccgaagtcggtgaggtaaccttttggagccagccgcctaaggtgggacaaatgattggggtgaagtcgtaacaaggtagccgtatcggaaggtgcggctggatcacctcctttcta

SEQ ID NO: 1651 - DNA, 1550 bp, Bacillus ligniniphilus
  ref <308>: DATABASE ACCESSION NUMBER: NCBI ACCESSION: NZ_ANNK01000138.1
  ref <309>: DATABASE ENTRY DATE: 2019-04-01
  ref <313>: RELEVANT RESIDUES IN SEQ ID NO: (1)..(1550)
ttcggagagtttgatcctggctcaggacgaacgctggcggcgtgcctaatacatgcaagtcgagcggaccaaagggagcttgctcctggaggttagcggcggacgggtgagtaacacgtgggcaacctgcctcgtagactgggataacaccgagaaatcggtgctaataccggatgatttctttctccgcatggagaaaggataaaagttggttctgctaacactacgagatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggattgtaaagttctgttgttagggaagaacacgtaccgttcgaaagggcggtaccttgacggtacctaacgagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccactctggagacagagctttccccttcgggggacaaagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtggagccaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaagttagccgtatcggaaggtgcggctggatcacctcctttcta

SEQ ID NO: 1652 - DNA, 1268 bp, Bacillus manliponensis
  ref <308>: DATABASE ACCESSION NUMBER: NCBI ACCESSION: NZ_JOTN01000063.1
  ref <309>: DATABASE ENTRY DATE: 2019-04-01
  ref <313>: RELEVANT RESIDUES IN SEQ ID NO: (1)..(1268)
acgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtacaagttgaataagcttgtaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggaaacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcagatcagcatgctgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1653 - DNA, 1569 bp, Bacillus mannanilyticus
  ref <308>: DATABASE ACCESSION NUMBER: NCBI ACCESSION: NZ_BAMO01000087.1
  ref <309>: DATABASE ENTRY DATE: 2019-04-01
  ref <313>: RELEVANT RESIDUES IN SEQ ID NO: (1)..(1569)
ttatatggagagtttgatcctggctcaggacgaacgctggcggcgtgcctaatacatgcaagtcgagcgagtgacgtaaggagaagccttcgggtggaagcttattgatctagcggcggacgggtgagtaacacgtaggcaacctgcctgtaagactgggataactccgggaaaccggagctaataccggatgacattttagaccgcatggtctgaaattgaaagatggcgcaagctatcacttacagatgggcctgcggcgcattagctagttggtggggtaatggctcaccaaggcgacgatgcgtagccgacctgagagggtgatcggccacactgggactgagacacggcccagactcctacgggaggcagcagtagggaatcttcggcaatggacgaaagtctgaccgagcaacgccgcgtgagtgatgaaggttttcggatcgtaaaactctgttgttagagaagaacaagtaccgtttgaataaggcggtaccttgacggtacctaacgagaaagccccggctaactacgtgccagcagccgcggtaatacgtagggggcaagcgttgtccggaattattgggcgtaaagcgcgcgcaggcggtttcttaagtctgatgtgaaagcccacggctcaaccgtggagggtcattggaaactgggaaacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttaggggtttcgatgcccttagtgccgacgttaacacattaagcactccgcctggggagtacggccgcaaggctgaaactcaaaggaattgacggggacccgcacaagcagtggagcatgtggtttaattcgaagcaacgcgaagaaccttaccaggacttgacatcctttgaccactctagagatagagctttccccttcgggggacaaagtgacaggtggtgcatggttgtcgtcagctcgtgtcgtgagatgttgggttaagtcccgcaacgagcgcaacccttaatcttagttgccagcattcagttgggcactctaaggtgactgccggtgacaaaccggaggaaggtggggatgacgtcaaatcatcatgccccttatgtcctgggctacacacgtgctacaatggacggtacaaagggcagcgaagccgcgaggtggagccaatcccataaagccgttctcagttcggattgcaggctgcaactcgcctgcatgaagccggaattgctagtaatcgcggatcagcatgccgcggtgaatacgttcccgggtcttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttcta

SEQ ID NO: 1654 - DNA, 1556 bp, Bacillus marisflavi
  ref <308>: DATABASE ACCESSION NUMBER: NCBI ACCESSION: NZ_FVYY01000009.1
  ref <309>: DATABASE ENTRY DATE: 2019-04-01
  ref <313>: RELEVANT RESIDUES IN SEQ ID NO: (1)..(1556)
tttatggagagtttgatcctggctcaggacgaacgctggcggcgtgcctaatacatgcaagtcgagcggatcgatgggagcttgctccctgaaatcagcggcggacgggtgagtaacacgtgggtaacctgcctgtaagactgggataactccgggaaaccggggctaataccggataacacctacccccctcatggggggaggttgaaaggtggcttcggctatcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtgccgttcgaatagggcggcgccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggacggtacaaagggctgcaagaccgcgaggtttagccaatcccataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaa

SEQ ID NO: 1655 - DNA, 1543 bp, Bacillus marmarensis
  ref <308>: DATABASE ACCESSION NUMBER: NCBI ACCESSION: NZ_ATAE01000068.1
  ref <309>: DATABASE ENTRY DATE: 2019-04-01
  ref <313>: RELEVANT RESIDUES IN SEQ ID NO: (1)..(1543)
ttttatggagagtttgattttggtttaggatgaatgttggtggtgtgtttaatatatgtaagttgagtggattgatgggagtttgttttttgatgttagtggtggatgggtgagtaatatgtgggtaatttgtttgtaagattgggataattttgggaaattggggttaatattggataatttgttttattttatggtggagtggtaaaagatggtttttggttattatttatagatgggtttgtggtgtattagttagttggtaaggtaattgtttattaaggtgatgatgtgtagttgatttgagagggtgattggttatattgggattgagatatggtttagatttttatgggaggtagtagtagggaattttttgtaatggatgaaagtttgatggagtaatgttgtgtgagtgatgaaggtttttggattgtaaagttttgttgttagggaagaataagtgttgtttgaataaggtggtattttgatggtatttaattagaaagttatggttaattatgtgttagtagttgtggtaatatgtaggtggtaagtgttgtttggaattattgggtgtaaagtgtgtgtaggtggttttttaagtttgatgtgaaagtttatggtttaattgtggagggttattggaaattgggagatttgagtatagaagaggagagtggaattttatgtgtagtggtgaaatgtgtagatatgtggaggaatattagtggtgaaggtgattttttggtttgtaattgatgttgaggtgtgaaagtgtggggagtaaataggattagatattttggtagtttatgttgtaaatgatgagtgttaggtgttaggggttttgatgtttttagtgttgaagttaatatattaagtattttgtttggggagtatgattgtaaggttgaaatttaaaggaattgatgggggtttgtataagtagtggagtatgtggtttaatttgaagtaatgtgaagaattttattaggttttgatattttttgattattttagagatagggtttttttttttgggggataaagtgataggtggtgtatggttgttgttagtttgtgttgtgagatgttgggttaagttttgtaatgagtgtaatttttgattttagttgttagtatttagttgggtattttaaggtgattgttggtgataaattggaggaaggtggggatgatgttaaattattatgttttttatgatttgggttatatatgtgttataatggatggtataaagggttgtaaaattgtgaggttgagtgaattttataaagttatttttagtttggattgtaggttgtaatttgtttatatgaagttggaattgttagtaattgtggattagtatgttgtggtgaatatgtttttgggttttgtatatattgtttgttatattatgagagtttgtaatatttgaagttggtgaggtaattttttggagttagttgtttaaggtgggatagatgattggggtgaagttgtaataaggtagttgtattggaaggtgtggttggat

SEQ ID NO: 1656 - DNA, 1461 bp, Bacillus massiliogorillae
  ref <308>: DATABASE ACCESSION NUMBER: NCBI ACCESSION: NZ_HG428752.1
  ref <309>: DATABASE ENTRY DATE: 2019-04-01
  ref <313>: RELEVANT RESIDUES IN SEQ ID NO: (1)..(1461)
gttagcggcggacgggtgagtaacacgtgggcaacctgcctataagactgggataacttcgggaaaccggagctaataccggatagttcttttcctctcatgaggaaaaggggaaagatggtttcggctatcacttatagatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtactagagtaactgctagtaccttgacggtacctaaccagaaagccacggctaactacgtgccagcagccgcggtaatacgtaggtggcaagcgttgtccggatttattgggcgtaaagcgcgcgcaggtggtttcttaagtctgatgtgaaagcccacggctcaaccgtggaaggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggtttagccaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttctaa

SEQ ID NO: 1657 - DNA, 1556 bp, Bacillus methanolicus
  ref <308>: DATABASE ACCESSION NUMBER: NCBI ACCESSION: NZ_CP007739.1
  ref <309>: DATABASE ENTRY DATE: 2019-04-01
  ref <313>: RELEVANT RESIDUES IN SEQ ID NO: (1)..(1556)
ttttttggagagtttgatcctggctcaggacgaacgctggcggcgtgcctaatacatgcaagtcgagcggactgatgggagcttgctccctgaagtcagcggcggacgggtgagtaacacgtgggcaacctgcctgtaagaccgggataacttcgggaaaccggagctaataccggataatcctctttcccgcatgggaaagagctgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtaccgttcgaatagggcggtgccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctggagacaggacgttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgatgccgcgaggctgagccaatcccaaaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaaccgcaaggagccagccgcctaaggtgggacagatgattggggtgaagtcgtaacaaggtagccgtatcggaaggtgcggctggatcacctcctttctaa

SEQ ID NO: 1658 - DNA, 1083 bp, Bacillus mojavensis
  ref <308>: DATABASE ACCESSION NUMBER: NCBI ACCESSION: NZ_AYTL01000008.1
  ref <309>: DATABASE ENTRY DATE: 2019-04-01
  ref <313>: RELEVANT RESIDUES IN SEQ ID NO: (1)..(1083)
aatagggcggtaccttgacggtacctaaccagaaagccacggctaactacgtgccagcagccgcggtaatacgtaggtggcaagcgttgtccggaattattgggcgtaaagggctcgcaggcggttccttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcaaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaa

SEQ ID NO: 1659 - DNA, 1552 bp, Bacillus muralis
  ref <308>: DATABASE ACCESSION NUMBER: NCBI ACCESSION: NZ_CP017080.1
  ref <309>: DATABASE ENTRY DATE: 2019-04-01
  ref <313>: RELEVANT RESIDUES IN SEQ ID NO: (1)..(1552)
tcggagagtttgatcctggctcaggacgaacgctggcggcgtgcctaatacatgcaagtcgagcgaatggatgggagcttgctccctgaagttagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttacgtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctttctaa

SEQ ID NO: 1660 - DNA, 1358 bp, Bacillus nakamurai
  ref <308>: DATABASE ACCESSION NUMBER: NCBI ACCESSION: NZ_LSBA01000011.1
  ref <309>: DATABASE ENTRY DATE: 2019-04-01
  ref <313>: RELEVANT RESIDUES IN SEQ ID NO: (1)..(1358)
ttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaa

SEQ ID NO: 1661 - DNA, 1363 bp, Bacillus ndiopicus
  ref <308>: DATABASE ACCESSION NUMBER: NCBI ACCESSION: NZ_HG964416.1
  ref <309>: DATABASE ENTRY DATE: 2019-04-01
  ref <313>: RELEVANT RESIDUES IN SEQ ID NO: (1)..(1363)
acatgttttgaagttgaaagatggttctgctatcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtgccgtagtaactggcggcaccttgacggtaccttattagaaagccacggctaactacgtgccagcagccgcggtaatacgtaggtggcaagcgttgtccggaattattgggcgtaaagcgcgcgcaggcggttctttaagtctgatgtgaaagcccccggctcaaccggggagggtcattggaaactggggaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactatggagacatggttttcccttcggggacaatggtgacaggtggtgcatggttgtcgtcagctcgtgtcgtgagatgttgggttaagtcccgcaacgagcgcaacccttgatcttagttgccatcatttagttgggcactctaaggtgactgccggtgataaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaa

SEQ ID NO: 1662 - DNA, 1458 bp, Bacillus niacini
  ref <308>: DATABASE ACCESSION NUMBER: NCBI ACCESSION: NZ_BCVA01000102.1
  ref <309>: DATABASE ENTRY DATE: 2019-04-01
  ref <313>: RELEVANT RESIDUES IN SEQ ID NO: (1)..(1458)
tttcttggagagtttgatcctggctcaggacgaacgctggcggcgtgcctaatacatgcaagtcgagcgaatcttgaggtgcttgcacctcttggttagcggcggacgggtgagtaacacgtgggcaacctgcctgtaagactgggataacttcgggaaaccggagctaataccggataatccttttcctctcatgagggaaagttgaaagtcggtttacgctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggactttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacc

SEQ ID NO: 1663 - DNA, 1603 bp, Bacillus niameyensis
  ref <308>: DATABASE ACCESSION NUMBER: NCBI ACCESSION: NZ_LN831197.1
  ref <309>: DATABASE ENTRY DATE: 2019-04-01
  ref <313>: RELEVANT RESIDUES IN SEQ ID NO: (1)..(1603)
ctttaaatgagagtttgatcctggctcaggacgaacgctggcggcgtgcctaatacatgcaagtcgagcgaatggatgggagcttgctccctgaagttagcggcggacgggtgagtaacacgtgggcaacctgcctgtaagactgggataactcgcggaaacgtgagctaataccggataatttctttcttcacatggagaaaggttgaaagacggttatgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttatcagggaagaacaagtaccgtttaactgacggtaccttgacggtacctgaccagaaagccacggctaactacgtgccagcagccgcggtaatacgtaggtggcaagcgttgtccggaattattgggcgtaaagcgcgcgcaggcggtctcttaagtctgatgtgaaatctcgcggctcaaccgtgagcggtcattggaaactgggggacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtctggagacaggcctttcccttcggggacagcggtgacaggtggtgcatggttgtcgtcagctcgtgtcgtgagatgttgggttaagtcccgcaacgagcgcaacccttgaaattagttgccagcatttagttgggcactctaatttgactgccggtgacaaaccggaggaaggtggggatgacgtcaaatcatcatgccccttatgacctgggctacacacgtgctacaatggatggtacagagggttgcgagaccgcgaggtttagccaatcccttaaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacctggtacttaacttagcctcttattaatatcgtaggaagctaagttaagtactaggagccagccgccgaaggtgggacagatgattggggtgaagtcgtaacaaggtagccgtatcggaaggtgcggctggatcacctcctttctaa

SEQ ID NO: 1664 - DNA, 1556 bp, Bacillus novalis
  ref <308>: DATABASE ACCESSION NUMBER: NCBI ACCESSION: NZ_KV440951.1
  ref <309>: DATABASE ENTRY DATE: 2019-04-01
  ref <313>: RELEVANT RESIDUES IN SEQ ID NO: (1)..(1556)
tttcttggagagtttgatcctggctcaggacgaacgctggcggcgtgcctaatacatgcaagtcgagcgaatctttgggagcttgctcccgagggtgagcggcggacgggtgagtaacacgtgggcaacctgcctgtaagactgggataacttcgggaaaccggagctaataccggataattcatttcctctcatggggaaatgctgaaagacggcctctcgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggtcgcaaagccgcaaggtctagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 1665 - DNA, 1339 bp, Bacillus obstructivus
  ref <308>: DATABASE ACCESSION NUMBER: NCBI ACCESSION: NZ_MPHG01000225.1
  ref <309>: DATABASE ENTRY DATE: 2019-04-01
  ref <313>: RELEVANT RESIDUES IN SEQ ID NO: (1)..(1339)
tcggctatcacttacagatggacccgcggcgcattagctagttggtgaggtaacggctcaccaaggcgacgatgcgtagccgacttgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaatcttgcggctcaaccgcaagcggccattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctcttgacctccctagagatagggatttcccttcggggacaggagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1666 - DNA, 1557 bp, Bacillus okhensis
  ref <308>: DATABASE ACCESSION NUMBER: NCBI ACCESSION: NZ_JRJU01000082.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcggactgattaagagcttgctcttatgacgttagcggcggacgggtgagtaacacgtgggcaacctgccctgtagatcgggataacaccgagaaatcggtgctaataccgggtaatatctgagatcacatgatcttaggttaaaagatggctccggctatcactacaggatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaagggtttcggctcgtaaagctctgttgttagggaagaacaagtatcgttcgaatagggcggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccactctagagatagagctttccccttcgggggacaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagagcagcgaaaccgcgaggtcgagccaatctcataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1667 - DNA, 1449 bp, Bacillus okuhidensis
  ref <308>: DATABASE ACCESSION NUMBER: NCBI ACCESSION: NZ_LILD01000018.1
  ref <309>: DATABASE ENTRY DATE: 2019-04-01
  ref <313>: RELEVANT RESIDUES IN SEQ ID NO: (1)..(1449)
tttatggagagtttgatcctggctcaggacgaacgctggcggcgtgcctaatacatgcaagtcgagcggaccaaagggagcttgctcctggaggttagcggcgaacgggtgagtaacacgtgggcaacctgcctgtaagactgggataacatcgagaaatcggtgctaataccggataataaaaagaactgcatggttcttttttgaaagatggtttcggctatcacttacagatgggcccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccgttcgaaagggcggcaccttgacggtacctaacgagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtacagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggttgcgaagccgcgaggtgaagccaatcccagaaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtg

SEQ ID NO: 1668 - DNA, 1557 bp, Bacillus oleronius
  ref <308>: DATABASE ACCESSION NUMBER: NCBI ACCESSION: NZ_MTLA01000059.1
  ref <309>: DATABASE ENTRY DATE: 2019-04-01
  ref <313>: RELEVANT RESIDUES IN SEQ ID NO: (1)..(1557)
tttttggagagtttgatcctggctcaggacgaacgctggcggcgtgcctaatacatgcaagtcgagcgaatctgatgggagcttgctccctgatgattagcggcggacgggtgagtaacacgtgggtaacctgcctgtaagactgggataactccgggaaaccggggctaataccggataacttttttcttcgcatgagggagaattgaaagatggcttcggctatcacttacagatggacccgcggcgcattagctagttggtgaggtaacggctcaccaaggcgacgatgcgtagccgacttgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaatcttgcggctcaaccgcaagcggccattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctcttgacctccctagagatagggatttcccttcggggacaggagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1669 - DNA, 1504 bp, Bacillus oryziterrae
  ref <308>: DATABASE ACCESSION NUMBER: NCBI ACCESSION: NZ_ANOK01000007.1
  ref <309>: DATABASE ENTRY DATE: 2019-04-01
  ref <313>: RELEVANT RESIDUES IN SEQ ID NO: (1)..(1504)
ttttcggagagtttgatcctggctcaggacgaacgctggcggcgtgcctaatacatgcaagtcgagcggaagtcaagaagcttgcttcttgactttagcggcggacgggtgagtaacacgtgggcaacctgcctgtaagactgggataacttcgggaaaccggagctaataccggataacttatcgcatcacatggtgagataataaaagatggtttcggctatcacttacagatgggcccgcggcgcattagctagttggagaggtaacggctccccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggttttcggatcgtaaagctctgttgttagggaagaacaggtagaagagtaactgcttttaccgtgacggtacctaacgagaaagccacggctaactacgtgccagcagccgcggtaatacgtaggtggcaagcgttgtccggaattattgggcgtaaagcgcgcgcaggcggttctttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatctcctgaaagctctagagatagagggatccccttcgggggacaggaagacaggtggtgcatggttgtcgtcagctcgtgtcgtgagatgttgggttaagtcccgcaacgagcgcaacccttgtccttagttgccagcattgagttgggcactctaaggagactgccggtgacaaaccggaggaaggtggggatgacgtcaaatcatcatgccccttatgacctgggctacacacgtgctacaatggatggtacaaagggaagcaagaccgcgaggtggagcgaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtc

SEQ ID NO: 1670 - DNA, 1554 bp, Bacillus oshimensis
  ref <308>: DATABASE ACCESSION NUMBER: NCBI ACCESSION: NZ_KV917380.1
  ref <309>: DATABASE ENTRY DATE: 2019-04-01
  ref <313>: RELEVANT RESIDUES IN SEQ ID NO: (1)..(1554)
ttttaacggagagtttgatcctggctcaggacgaacgctggcggcgtgcctaatacatgcaagtcgagcggacagaagggagcttgctcccggacgttagcggcggacgggtgagtaacacgtaggtaacctgccccttagactgggataactccgggaaaccggagctaatacgggataataaagagaatcacctgattctcttttgaaagacggcgtctagctgtcactaagggatgggcctgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgtgagggaagaacaagtaccggggtaactaccggtaccttgacggtacctcaccagaaagccacggctaactacgtgccagcagccgcggtaatacgtaggtggcaagcgttgtccggaattattgggcgtaaagcgcgcgcaggcggcttcttaagtctgatgtgaaatctcggggctcaaccccgagcggccattggaaactgggaagcttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagtaaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggacgacgtcaaatcatcatgccccttatgacctgggctacacacgtgctacaatggatggtacaaagggcagcgaaaccgcgaggtggagccaatcccataaagccattctcagttcggattgtaggctgcaactcgcctacatgaagccggaattgctagtaatcgcggatcagcatgccgcggtgaatacgttcccgggtcttgtacacaccgcccgtcacaccacgagagtttgtaacacccgaagtcggtgaggtaaccttttggagccagccgcctaaggtgggacaaatgattggggtgaagtcgtaacaaggtagccgtatcggaaggtgcggctggatcacctcctttcta

SEQ ID NO: 1671 - DNA, 321 bp, Bacillus panaciterrae
  ref <308>: DATABASE ACCESSION NUMBER: NCBI ACCESSION: NZ_AUMR01000092.1
  ref <309>: DATABASE ENTRY DATE: 2019-04-01
  ref <313>: RELEVANT RESIDUES IN SEQ ID NO: (1)..(321)
ttttatggagagtttgatcctggctcaggatgaacgctggcggcgtgcctaatacatgcaagtcgagcgaacctcttcggaggttagcggcggacgggtgagtaacacgtgggtaacctgcctgtaagactgggataacttcgggaaaccgaagctaataccggatacttttttgagtcgcatgactcgaaatggaaagacggcttcggctgtcacttacagatggacccgcgtcgcattagctagttggtgaggtaacggctcaccaaggcgacgatgcgtagccgacctgagagggtgatcggccacactgggactgag

SEQ ID NO: 1672 - DNA, 1557 bp, Bacillus patagoniensis
  ref <308>: DATABASE ACCESSION NUMBER: NCBI ACCESSION: NZ_KV917377.1
  ref <309>: DATABASE ENTRY DATE: 2019-04-01
  ref <313>: RELEVANT RESIDUES IN SEQ ID NO: (1)..(1557)
attttaacggagagtttgatcctggctcaggacgaacgctggcggcatgcctaatacatgcaagtcgagcggacagaagggagcttgctcccggaagtcagcggcggacgggtgagtaacacgtgggcaacctgccccttagactgggataacttcgggaaaccgaagctaataccggataacacttttttccacctgggagaaagttaaaagatggcgtttgtgctatcactaggggatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaatgccgcgtgagtgaggaaggccttcgggtcgtaaagctctgttgtgagggaagaacaagtatcggttgaataagccggtaccttgacggtacctcaccagaaagccacggctaactacgtgccagcagccgcggtaatacgtaggtggcaagcgttgtccggaattattgggcgtaaagcgcgcgcaggcggcttcttaagtctgatgtgaaatctcggggctcaaccccgagcggccattggaaactgggaagcttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagtaaacacattaagcactccgcctggggagtacgaccgcaaggttgaaactcaaaggaattgacggggacccgcacaagcagtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggacgacgtcaaatcatcatgccccttatgacctgggctacacacgtgctacaatggatggtacaaagggttgcgaagccgcgaggtgaagccaatcccataaagccattctcagttcggattgtaggctgcaactcgcctacatgaagccggaattgctagtaatcgcggatcagcatgccgcggtgaatacgttcccgggtcttgtacacaccgcccgtcacaccacgagagtttgtaacacccgaagtcggtgaggtaaccttttggagccagccgcctaaggtgggacaaatgattggggtgaagtcgtaacaaggtagccgtatcggaaggtgcggctggatcacctcctttcta

SEQ ID NO: 1673 - DNA, 1462 bp, Bacillus pseudofirmus
  ref <308>: DATABASE ACCESSION NUMBER: NCBI ACCESSION: NZ_MSLQ01000031.1
  ref <309>: DATABASE ENTRY DATE: 2019-04-01
  ref <313>: RELEVANT RESIDUES IN SEQ ID NO: (1)..(1462)
gttagcggcggacgggtgagtaacacgtgggcaacctgcctgtaagactgggataactccgggaaaccggggctaataccggataacccgttccacctcatggtggagcggtaaaagatggcctctggctatcacttacagatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgtttgaataaggcggcaccttgacggtacctaaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccactctagagatagagctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcgaggttgagcgaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 1674 - DNA, 1357 bp, Bacillus psychrosaccharolyticus
  ref <308>: DATABASE ACCESSION NUMBER: NCBI ACCESSION: NZ_AJTN02000107.1
  ref <309>: DATABASE ENTRY DATE: 2019-04-01
  ref <313>: RELEVANT RESIDUES IN SEQ ID NO: (1)..(1357)
agaagatggaaagacggtctcggctgtcacttatagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggctttcgggtcgtaaagttctgttgttagggaagaacaagtaccagagtaactgctggtaccttgacggtacctaaccagaaagccacggctaactacgtgccagcagccgcggtaatacgtaggtggcaagcgttatccggaattattgggcgtaaagcgcgcgcaggtggttccttaagtctgatgtgaaagcccccggctcaaccggggagggtcattggaaactggggaacttgagtgtagaagaggaaagtggaattccacgtgtagcggtgaaatgcgtagagatgtggaggaacaccagtggcgaaggcgactttctggtctataactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggatggtacaaagagctgcaaacccgcgagggtaagcgaatctcataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccgcaaggagccagccgcctaaggtgggacagatgattggggtgaagtcgtaacaaggtagccgtatcggaaggtgcggctggatcacctcctttctaa

SEQ ID NO: 1675 - DNA, 440 bp, Bacillus rhizosphaerae
  ref <308>: DATABASE ACCESSION NUMBER: NCBI ACCESSION: NZ_FRBS01000010.1
  ref <309>: DATABASE ENTRY DATE: 2019-04-01
  ref <313>: RELEVANT RESIDUES IN SEQ ID NO: (1)..(440)
tttaacggagagtttgatcctggctcaggacgaacgctggcggcgtgcctaatacatgcaagtcgagcggacagaagggagcttgctcccggacgttagcggcggacgggtgagtaacacgtgggcaacctgccccttagactgggataactccgggaaaccggagctaataccggataatccctttctccacctggagagagggtgaaagatggcttcggctatcactaggggatgggcccgcggcgcattagctagttggtaaggtaacggcttaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaag

SEQ ID NO: 1676 - DNA, 1557 bp, Bacillus rubiinfantis
  ref <308>: DATABASE ACCESSION NUMBER: NCBI ACCESSION: NZ_CCFE01000021.1
  ref <309>: DATABASE ENTRY DATE: 2019-04-01
  ref <313>: RELEVANT RESIDUES IN SEQ ID NO: (1)..(1557)
ctttattggagagtttgatcctggctcaggacgaacgctggcggcgtgcctaatacatgcaagtcgagcgaacctgataaagcttgcttttgaaggttagcggcggacgggtgagtaacacgtgggcaacctgcctgtaagactgggataacaccgggaaaccggtgctaataccggataattcttatcaactcatgttgataagctgaaagtcggcgcaagctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggcttaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgatactcctagagataggattttccccttcgggggacagagtgacaggtggtgcatggttgtcgtcagctcgtgtcgtgagatgttgggttaagtcccgcaacgagcgcaacccttgatcttagttgccagcattaggttgggcactctaaggtgactgccggtgacaaaccggaggaaggtggggatgacgtcaaatcatcatgccccttatgacctgggctacacacgtgctacaatggatggtacaaagggcagcgaaaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttctaa

SEQ ID NO: 1677 - DNA, 1353 bp, Bacillus selenatarsenatis
  ref <308>: DATABASE ACCESSION NUMBER: NCBI ACCESSION: NZ_BASE01000050.1
  ref <309>: DATABASE ENTRY DATE: 2019-04-01
  ref <313>: RELEVANT RESIDUES IN SEQ ID NO: (1)..(1353)
gctgaaagacggtttcggctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggctttcgggtcgtaaagttctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggtcgcgaagccgcgaggtcgagccaatcccataaatccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttctaa

SEQ ID NO: 1678 - DNA, 1557 bp, Bacillus shacheensis
  ref <308>: DATABASE ACCESSION NUMBER: NCBI ACCESSION: NZ_LLYY01000072.1
  ref <309>: DATABASE ENTRY DATE: 2019-04-01
  ref <313>: RELEVANT RESIDUES IN SEQ ID NO: (1)..(1557)
ctttaatggagagtttgatcctggctcaggacgaacgctggcggcatgcctaatacatgcaagtcgagcgaaccaaagggagcttgctcccagaggttagcggcggacgggtgagtaccacgtgggcaacctgccccatggacggggataactccgggaaaccggagctaataccggataacaccgaccttcgcctgaaggttggttgaaagatggcctttaaggctatcaccaagggatgggcccgcggcgcattagctagttggtaaggtaaaggcttaccaaggcgacgatgcgtagccgacctgagagggtgatcggccacactgggactgagacacggcccagactcctacgggaggcagcagtagggaatcttccgcaatggacgaaagtctgacggagcaatgccgcgtgagtgaggaaggccttcgggtcgtaaagctctgttgcgagggaagaagcaagtaccggtggataacgccggtaccctgacggtacctcgccagaaagccacggctaactacgtgccagcagccgcggtaatacgtaggtggcaagcgttgtccggaattattgggcgtaaagcgcgcgcaggcggcttcttaagtctgatgtgaaatctcggggctcaaccccgagcggccattggaaactggggagcttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagttaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccaccctggagacagggcttccccttcgggggcaaagtgacaggtggtgcatggttgtcgtcagctcgtgtcgtgagatgttgggttaagtcccgcaacgagcgcaacccttaatcttagttgccagcattgagttgggcactctaaggtgactgccggtgacaaaccggaggaaggtggggacgacgtcaaatcatcatgccccttatgacctgggctacacacgtgctacaatggatggtacaacgggtagcgaagccgtgaggtgaagccaatcccagaaagccattctcagttcggattgcaggctgcaactcgcctgcatgaagccggaattgctagtaatcgcggatcagcatgccgcggtgaatacgttcccgggtcttgtacacaccgcccgtcacaccacgagagtttgtaacacccgaagtcggtgaggtaacctttggagccagccgcctaaggtgggacagatgattggggtgaagtcgtaacaaggtagccgtatcggaaggtgcggctggatcacctcctttcta

SEQ ID NO: 1679 - DNA, 1556 bp, Bacillus shackletonii
  ref <308>: DATABASE ACCESSION NUMBER: NCBI ACCESSION: NZ_LJJC01000011.1
  ref <309>: DATABASE ENTRY DATE: 2019-04-01
  ref <313>: RELEVANT RESIDUES IN SEQ ID NO: (1)..(1556)
ttttttggagagtttgatcctggctcaggacgaacgctggcggcgtgcctaatacatgcaagtcgagcggacttttaaaagcttgcttttaaaagttagcggcggacgggtgagtaacacgtgggtaacctgcctgtaagactgggataactccgggaaaccggggctaataccggataacttctttcctcgcatgaggaaagattgaaagatggcttcggctatcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1680 - DNA, 1552 bp, Bacillus simplex; identical to SEQ ID NO: 191
  ref <308>: DATABASE ACCESSION NUMBER: NCBI ACCESSION: NZ_FTMX01000030.1
  ref <309>: DATABASE ENTRY DATE: 2019-04-01
  ref <313>: RELEVANT RESIDUES IN SEQ ID NO: (1)..(1552)

SEQ ID NO: 1681 - DNA, 1558 bp, Bacillus sinesaloumensis
  ref <308>: DATABASE ACCESSION NUMBER: NCBI ACCESSION: NZ_LT732529.1
  ref <309>: DATABASE ENTRY DATE: 2019-04-01
  ref <313>: RELEVANT RESIDUES IN SEQ ID NO: (1)..(1558)
tcttattggagagtttgatcctggctcaggatgaacgctggcggcgtgcctaatacatgcaagtcgagcgaacttttgggagcttgctcccaaaagttagcggcggacgggtgagtaacacgtgggtaacctgcctgtaagactgggataacttcgggaaaccggagctaataccggataacatcgaagaccacatggtcttcaattaaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtatcgttcgaatagggcggtaccttgacggtacctaaccagaaagccacggctaactacgtgccagcagccgcggtaatacgtaggtggcaagcgttatccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatccttatgccatccctagagatagggctttcctttcgaggacataagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaaaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttctaa

SEQ ID NO: 1682 - DNA, 1559 bp, Bacillus smithii
  ref <308>: DATABASE ACCESSION NUMBER: NCBI ACCESSION: NZ_BCVY01000127.1
  ref <309>: DATABASE ENTRY DATE: 2019-04-01
  ref <313>: RELEVANT RESIDUES IN SEQ ID NO: (1)..(1559)
ctttttggagagtttgatcctggctcaggacgaacgctggcggcgtgcctaatacatgcaagtcgagcggactttcaagaagcttgctttttgaaagttagcggcggacgggtgagtaacacgtgggcaacctgcctgcaagacggggataactccgggaaaccggggctaataccggataatatcttccttcgcatgaaggaaggttgaaaggcggcgcaagctgccgcttgcagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgtcagggaagaacaagtaccgttcgaacagggcggtaccttgacggtacctgaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggagacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggcttccaccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttcgctacctctagagatagagggttccccttcgggggacggagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggtcgcgaaaccgcgaggtggagctaatcccaaaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcagatgattggggtgaagtcgtaacaaggtagccgtatcggaaggtgcggctggatcacctcctttcta

SEQ ID NO: 1683 - DNA, 1556 bp, Bacillus solani
  ref <308>: DATABASE ACCESSION NUMBER: NCBI ACCESSION: NZ_LJIX01000006.1
  ref <309>: DATABASE ENTRY DATE: 2019-04-01
  ref <313>: RELEVANT RESIDUES IN SEQ ID NO: (1)..(1556)
tttattggagagtttgatcctggctcaggacgaacgctggcggcgtgcctaatacatgcaagtcgagcgaatctgagggagcttgctcccaaagattagcggcggacgggtgagtaacacgtgggcaacctgcctgtaagactgggataacttcgggaaaccggagctaataccggataatccttttctactcatgtagaaaagctgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccccggctcaaccggggagggtcattggaaactgggagacttgagtgcagaagaggaaagtggaattccaagtgtagcggtgaaatgcgtagagatttggaggaacaccagtggcgaaggcgactttctggtctgtaactgacactgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttctaa

SEQ ID NO: 1684 - DNA, 1558 bp, Bacillus solimangrovi
  ref <308>: DATABASE ACCESSION NUMBER: NCBI ACCESSION: NZ_MJEH01000058.1
  ref <309>: DATABASE ENTRY DATE: 2019-04-01
  ref <313>: RELEVANT RESIDUES IN SEQ ID NO: (1)..(1558)
ttttatcggagagtttgatcctggctcaggacgaacgctggcggcgtgcctaatacatgcaagtcgagcggatgaaagggagcttgctccctggattcagcggcggacgggtgagtaacacgtgggcaacctgcctgtaagactgggataacttcgggaaaccggagctaataccggataatcaacagaactgcatggttctgttgtaaaagacggttttgctgtcacttacagatgggcccgcggcgcattagttagttggtggggtaacggcctaccaagacgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggccttcgggtcgtaaagctctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccgcagctcaactgcggagggtcattggaaactggggaacttgagtacagaagaggaaagtggaattccatgtgtagcggtgaaatgcgtagatatatggaggaacaccagtggcgaaggcgactttctggtctgtaactgacgctgaggcgcgaaagcgtggggagcgaacaggattagataccctggtagtccacgccgtaaacgatgagtgctaagtgttagggggtttccgccccttagtgctgaagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgtccttagttgccagcattcagttgggcactctaaggagactgccggtgacaaaccggaggaaggtggggatgacgtcaaatcatcatgccccttatgacctgggctacacacgtgctacaatggatggtacaaagggcagcaagaccgcgaggtttagccaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacctttatggagccagccgccgaaggtgggacagatgattggggtgaagtcgtaacaaggtagccgtatcggaaggtgcggctggatcacctcctttctaaggaa

SEQ ID NO: 1685 - DNA, 1478 bp, Bacillus sonorensis
  ref <308>: DATABASE ACCESSION NUMBER: NCBI ACCESSION: NZ_LT745768.1
  ref <309>: DATABASE ENTRY DATE: 2019-04-01
  ref <313>: RELEVANT RESIDUES IN SEQ ID NO: (1)..(1478)
gggagcttgctccctgaggttagcggcggacgggtgagtaacacgtgggtaacctgcctgtaagactgggataactccgggaaaccggggctaataccggatgcttgattgaaccgcatggttcaatcataaaagatggcttcggctatcacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaacagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacacccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1686 - DNA, 218 bp, Bacillus sp. 105MF
  ref <308>: DATABASE ACCESSION NUMBER: NCBI ACCESSION: NZ_KB895612.1
  ref <309>: DATABASE ENTRY DATE: 2019-04-01
  ref <313>: RELEVANT RESIDUES IN SEQ ID NO: (1)..(218)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgcaccgcatggtgcgaaattcaaaggcggc

SEQ ID NO: 1687 - DNA, 208 bp, Bacillus sp. 123MFChir2
  ref <308>: DATABASE ACCESSION NUMBER: NCBI ACCESSION: NZ_KB910992.1
  ref <309>: DATABASE ENTRY DATE: 2019-04-01
  ref <313>: RELEVANT RESIDUES IN SEQ ID NO: (1)..(208)
tttattggagagtttgatcctggctcaggatgaacgctggcggcgtgcctaatacatgcaagtcgagcgaaccgattaagagcttgctcttaagaagttagcggcggacgggtgagtaacacgtgggtaacctgcctataagactgggataactccgggaaaccggggctaataccggataacattttgcaccgcatggtgcgaaatt

SEQ ID NO: 1688 - DNA, 258 bp, Bacillus sp. 171095 106
  ref <308>: DATABASE ACCESSION NUMBER: NCBI ACCESSION: NZ_AZVK01000006.1
  ref <309>: DATABASE ENTRY DATE: 2019-04-01
  ref <313>: RELEVANT RESIDUES IN SEQ ID NO: (1)..(258)
ttcttcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagct

SEQ ID NO: 1689 - DNA, 1556 bp, Bacillus sp. 17376; identical to SEQ ID NO: 1618
  ref <308>: DATABASE ACCESSION NUMBER: NCBI ACCESSION: NZ_KI547226.1
  ref <309>: DATABASE ENTRY DATE: 2019-04-01
  ref <313>: RELEVANT RESIDUES IN SEQ ID NO: (1)..(1556)

SEQ ID NO: 1690 - DNA, 1556 bp, Bacillus sp. 1NLA3E
  ref <308>: DATABASE ACCESSION NUMBER: NCBI ACCESSION: NC_021171.1
  ref <309>: DATABASE ENTRY DATE: 2019-04-01
  ref <313>: RELEVANT RESIDUES IN SEQ ID NO: (1)..(1556)
tttcttggagagtttgatcctggctcaggacgaacgctggcggcgtgcctaatacatgcaagtcgagcggattgatgggagcttgctccctgatatcagcggcggacgggtgagtaacacgtgggcaacctgcctgtaagactgggataacaccgggaaaccggtgctaataccggataatccttttcctctcatgaggaaaagctgaaagacggtttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggtggtacaaagggttgcaaaacccgcgaggtcgagccaatcccataaaaccactctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 1691 - DNA, 1342 bp, Bacillus sp. 220 BSPC
  ref <308>: DATABASE ACCESSION NUMBER: NCBI ACCESSION: NZ_JVPL01000147.1
  ref <309>: DATABASE ENTRY DATE: 2019-04-01
  ref <313>: RELEVANT RESIDUES IN SEQ ID NO: (1)..(1342)
agaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctgg

SEQ ID NO: 1692 - DNA, 1555 bp, Bacillus sp. 275
  ref <308>: DATABASE ACCESSION NUMBER: NCBI ACCESSION: NZ_CP019626.1
  ref <309>: DATABASE ENTRY DATE: 2019-04-01
  ref <313>: RELEVANT RESIDUES IN SEQ ID NO: (1)..(1555)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaa

SEQ ID NO: 1693 - DNA, 243 bp, Bacillus sp. 278922 107
  ref <308>: DATABASE ACCESSION NUMBER: NCBI ACCESSION: NZ_AZVI01000006.1
  ref <309>: DATABASE ENTRY DATE: 2019-04-01
  ref <313>: RELEVANT RESIDUES IN SEQ ID NO: (1)..(243)
ttcttcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcc

SEQ ID NO: 1694 - DNA, 1217 bp, Bacillus sp. 37MA
  ref <308>: DATABASE ACCESSION NUMBER: NCBI ACCESSION: NZ_KB889752.1
  ref <309>: DATABASE ENTRY DATE: 2019-04-01
  ref <313>: RELEVANT RESIDUES IN SEQ ID NO: (1)..(1217)
ctttttggagagtttgatcctggctcaggacgaacgctggcggcgtgcctaatacatgcaagtcgagcggacttgacggagcttgctccgttcaagttagcggcggacgggtgagtaacacgtgggcaacctgccctgcagattgggataactccgggaaaccggggctaataccgaataatatcgaagatttcatgatcttcttttgaaagatggcatctcgctgtcactgcaggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacacgtacgggagtaactgtccgtaccttgacggtacctgaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggaaggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtatagagatatacttttcccttcggggacagcggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatg

SEQ ID NO: 1695 - DNA, 1556 bp, Bacillus sp. 4048
  ref <308>: DATABASE ACCESSION NUMBER: NCBI ACCESSION: NZ_MAOB01000029.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 1696 - DNA, 1358 bp, Bacillus sp. 445 BSPC
  ref <308>: DATABASE ACCESSION NUMBER: NCBI ACCESSION: NZ_JVGU01000055.1
  ref <309>: DATABASE ENTRY DATE: 2019-04-01
  ref <313>: RELEVANT RESIDUES IN SEQ ID NO: (1)..(1358)
agaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctttctaa

SEQ ID NO: 1697 - DNA, 1222 bp, Bacillus sp. 522 BSPC
  ref <308>: DATABASE ACCESSION NUMBER: NCBI ACCESSION: NZ_JVDT01000030.1
  ref <309>: DATABASE ENTRY DATE: 2019-04-01
  ref <313>: RELEVANT RESIDUES IN SEQ ID NO: (1)..(1222)
cttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaagcggtgacgcctagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggt

SEQ ID NO: 1698 - DNA, 1839 bp, Bacillus sp. 5B6
  ref <308>: DATABASE ACCESSION NUMBER: NCBI ACCESSION: NZ_AJST01000001.1
  ref <309>: DATABASE ENTRY DATE: 2019-04-01
  ref <313>: RELEVANT RESIDUES IN SEQ ID NO: (1)..(1839)
tttatcggagagtttgatcctggctcaggacgaacgctggcggcgtgcctaatacatgcaagtcgagcggacagatgggagcttgctccctgatgttagcggcggacgggtgagtaacacgtgggtaacctacctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1699 - DNA, 1563 bp, Bacillus sp. 72
  ref <308>: DATABASE ACCESSION NUMBER: NCBI ACCESSION: NZ_JQMI01000018.1
  ref <309>: DATABASE ENTRY DATE: 2019-04-01
  ref <313>: RELEVANT RESIDUES IN SEQ ID NO: (1)..(1563)
ctttttggagagtttgatcctggctcaggacgaacgctggcggcgtgcctaatacatgcaagtcgagcggacttgacggagcttgctccgttcaagttagcggcggacgggtgagtaacacgtgggcaacctgccctgcagattgggataactccgggaaaccggggctaataccgaataatatcgaagatttcatgatcttcttttgaaagatggcatctcgctgtcactgcaggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacacgtacgggagtaactgtccgtaccttgacggtacctgaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggaaggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtatagagatatacttttcccttcggggacagcggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaaggaa

SEQ ID NO: 1700 - DNA, 210 bp, Bacillus sp. 95MFCvi2.1
  ref <308>: DATABASE ACCESSION NUMBER: NCBI ACCESSION: NZ_KB895698.1
  ref <309>: DATABASE ENTRY DATE: 2019-04-01
  ref <313>: RELEVANT RESIDUES IN SEQ ID NO: (1)..(210)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgcaccgcatggtgcgaaattca

SEQ ID NO: 1701 - DNA, 1556 bp, Bacillus sp. A053
  ref <308>: DATABASE ACCESSION NUMBER: NCBI ACCESSION: NZ_JXAJ01000002.1
  ref <309>: DATABASE ENTRY DATE: 2019-04-01
  ref <313>: RELEVANT RESIDUES IN SEQ ID NO: (1)..(1556)
atttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1702 - DNA, 1558 bp, Bacillus sp. ABP14
  ref <308>: DATABASE ACCESSION NUMBER: NCBI ACCESSION: NZ_CP017016.1
  ref <309>: DATABASE ENTRY DATE: 2019-04-01
  ref <313>: RELEVANT RESIDUES IN SEQ ID NO: (1)..(1558)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataaatcattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtctccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaaggccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 1703 - DNA, 1554 bp, Bacillus sp. AM 13 2015
  ref <308>: DATABASE ACCESSION NUMBER: NCBI ACCESSION: NZ_LKCP01000056.1
  ref <309>: DATABASE ENTRY DATE: 2019-04-01
  ref <313>: RELEVANT RESIDUES IN SEQ ID NO: (1)..(1554)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctggcaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1704 - DNA, 1075 bp, Bacillus sp. Aph1
  ref <308>: DATABASE ACCESSION NUMBER: NCBI ACCESSION: NZ_ANNS01000033.1
  ref <309>: DATABASE ENTRY DATE: 2019-04-01
  ref <313>: RELEVANT RESIDUES IN SEQ ID NO: (1)..(1075)
gtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttctaa

SEQ ID NO: 1705 - DNA, 1557 bp, Bacillus sp. B-jedd
  ref <308>: DATABASE ACCESSION NUMBER: NCBI ACCESSION: NZ_CCXR01000001.1
  ref <309>: DATABASE ENTRY DATE: 2019-04-01
  ref <313>: RELEVANT RESIDUES IN SEQ ID NO: (1)..(1557)
tttcttggagagtttgatcctggctcaggacgaacgctggcggcgtgcctaatacatgcaagtcgagcggaggttttgaaagcttgctttcgaaacctcagcggcggacgggtgagtaacacgtgggcaacctgcctgtaagactgggataactccgggaaaccggggctaataccggataaccctcattgacacatgtcgatgagctgaaagacggtttcggctgtcacttacagatgggcccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggcctcttaagtctgatgtgaaagcccacggctcaaccgtggagggtcattggaaactggggggcttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgggagtttgtaacacccgaagtcggtggggtaaccgcaaggggccagccgcctaaggtgggacagatgactggggtgaagtcgtaacaaggtagccgtatcggaaggtgcggctggatcacctcctttctaa

SEQ ID NO: 1706 - DNA, 1555 bp, Bacillus sp. BH072
  ref <308>: DATABASE ACCESSION NUMBER: NCBI ACCESSION: NZ_CP009938.1
  ref <309>: DATABASE ENTRY DATE: 2019-04-01
  ref <313>: RELEVANT RESIDUES IN SEQ ID NO: (1)..(1555)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1707 - DNA, 1557 bp, Bacillus sp. CBA7126
  ref <308>: DATABASE ACCESSION NUMBER: NCBI ACCESSION: NZ_BDJJ01000001.1
  ref <309>: DATABASE ENTRY DATE: 2019-04-01
  ref <313>: RELEVANT RESIDUES IN SEQ ID NO: (1)..(1557)
tatttcatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttcaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1708 - DNA, 300 bp, Bacillus sp. CC120222-01
  ref <308>: DATABASE ACCESSION NUMBER: NCBI ACCESSION: NZ_FWZZ01000013.1
  ref <309>: DATABASE ENTRY DATE: 2019-04-01
  ref <313>: RELEVANT RESIDUES IN SEQ ID NO: (1)..(300)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccga

SEQ ID NO: 1709 - DNA, 1558 bp, Bacillus sp. CHD6a; identical to SEQ ID NO: 108
  ref <308>: DATABASE ACCESSION NUMBER: NCBI ACCESSION: NZ_LBMD01000048.1
  ref <309>: DATABASE ENTRY DATE: 2019-04-01
  ref <313>: RELEVANT RESIDUES IN SEQ ID NO: (1)..(1558)

SEQ ID NO: 1710 - DNA, 1555 bp, Bacillus sp. CMAA 1185
  ref <308>: DATABASE ACCESSION NUMBER: NCBI ACCESSION: NZ_LAKC01000010.1
  ref <309>: DATABASE ENTRY DATE: 2019-04-01
  ref <313>: RELEVANT RESIDUES IN SEQ ID NO: (1)..(1555)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1711 - DNA, 1556 bp, Bacillus sp. Co1-6
  ref <308>: DATABASE ACCESSION NUMBER: NCBI ACCESSION: NZ_CVPA01000001.1
  ref <309>: DATABASE ENTRY DATE: 2019-04-01
  ref <313>: RELEVANT RESIDUES IN SEQ ID NO: (1)..(1556)
atttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggctttggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1712 - DNA, 1557 bp, Bacillus sp. EB01
  ref <308>: DATABASE ACCESSION NUMBER: NCBI ACCESSION: NZ_HG964497.1
  ref <309>: DATABASE ENTRY DATE: 2019-04-01
  ref <313>: RELEVANT RESIDUES IN SEQ ID NO: (1)..(1557)
ctttattggagagtttgatcctggctcaggacgaacgctggcggcgtgcctaatacatgcaagtcgagcggggttttaaaagcttgcttttaaaactttagcggcggacgggtgagtaacacgtgggcaacctgcctgtaagactgggataacaccgggaaaccggtgctaataccggataatcctttctgacacatgtcgggaagctgaaagacggtttcggctgtcacttacagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaactctggagacagagcgttccccttcgggggacagagtgacaggtggtgcatggttgtcgtcagctcgtgtcgtgagatgttgggttaagtcccgcaacgagcgcaacccttgtccttagttgccagcatttagttgggcactctagggagactgccggtgacaaaccggaggaaggtggggatgacgtcaaatcatcatgccccttatgacctgggctacacacgtgctacaatggatggtacaaagggcagcgaagccgcgaggtgaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1713 - DNA, 1554 bp, Bacillus sp. F56
  ref <308>: DATABASE ACCESSION NUMBER: NCBI ACCESSION: NZ_BDFC01000001.1
  ref <309>: DATABASE ENTRY DATE: 2019-04-01
  ref <313>: RELEVANT RESIDUES IN SEQ ID NO: (1)..(1554)
ttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1714 - DNA, 1556 bp, Bacillus sp. FJAT-14266; identical to SEQ ID NO: 1636
  ref <308>: DATABASE ACCESSION NUMBER: NCBI ACCESSION: NZ_CP017072.1
  ref <309>: DATABASE ENTRY DATE: 2019-04-01
  ref <313>: RELEVANT RESIDUES IN SEQ ID NO: (1)..(1556)

SEQ ID NO: 1715 - DNA, 1556 bp, Bacillus sp. FJAT-14578
  ref <308>: DATABASE ACCESSION NUMBER: NCBI ACCESSION: NZ_AYSE01000015.1
  ref <309>: DATABASE ENTRY DATE: 2019-04-01
  ref <313>: RELEVANT RESIDUES IN SEQ ID NO: (1)..(1556)
ttcttcggagagtttgatcctggctcaggacgaacgctggcggcgtgcctaatacatgcaagtcgagcggacagatgggagcttgctccctgaagtcagcggcggacgggtgagtaacacgtgggcaacctgcctgtaagactgggataacttcgggaaaccggagctaataccggataacaccgaggacctcatggtccttggttgaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagagtcgcgagaccgcgaggtggagctaatctcataaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaaccgtaaggagccagccgcctaaggtggggtagatgattggggtgaagtcgtaacaaggtagccgtatcggaaggtgcggctggatcacctcctttctaa

SEQ ID NO: 1716 - DNA, 1557 bp, Bacillus sp. FJAT-18017
  ref <308>: DATABASE ACCESSION NUMBER: NCBI ACCESSION: NZ_CP012602.1
  ref <309>: DATABASE ENTRY DATE: 2019-04-01
  ref <313>: RELEVANT RESIDUES IN SEQ ID NO: (1)..(1557)
ctttattggagagtttgatcctggctcaggacgaacgctggcggcgtgcctaatacatgcaagtcgagcggggttttaaaagcttgcttttaaaactttagcggcggacgggtgagtaacacgtgggcaacctgcctgtaagactgggataacaccgggaaaccggtgctaataccggataatcctttctgacacatgtcgggaagctgaaagacggtttcggctgtcacttacagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaactctggagacagagcgttccccttcgggggacagagtgacaggtggtgcatggttgtcgtcagctcgtgtcgtgagatgttgggttaagtcccgcaacgagcgcaacccttgtccttagttgccagcattcagttgggcactctagggagactgccggtgacaaaccggaggaaggtggggatgacgtcaaatcatcatgccccttatgacctgggctacacacgtgctacaatggatggtacaaagggcagcgaagccgcgaggtgaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1717 - DNA, 1566 bp, Bacillus sp. FJAT-18019
  ref <308>: DATABASE ACCESSION NUMBER: NCBI ACCESSION: NZ_LITP01000001.1
  ref <309>: DATABASE ENTRY DATE: 2019-04-01
  ref <313>: RELEVANT RESIDUES IN SEQ ID NO: (1)..(1566)
tttattggagagtttgatcctggctcaggacgaacgctggcggcgtgcctaatacatgcaagtcgagcggacttgatggagagcttgctctcctgagagttagcggcggacgggtgagtaacacgtaggtaacctgcccttaagactgggataactaccggaaacggtagctaataccggataatttattttgctgcatggcgaaataatgaaagacggagcaatctgtcacttgaggatggacctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcttgagagagtaactgctcttgaggtgacggtacctgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcattggaaactgggggacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaccggtacagagatgtacctttccttcgggacagaggtgacaggtggtgcatggttgtcgtcagctcgtgtcgtgagatgttgggttaagtcccgcaacgagcgcaacccttgattttagttgccagcacgtaatggtgggcactctagaatgactgccggtgacaaaccggaggaaggcggggatgacgtcaaatcatcatgccccttatgacttgggctacacacgtactacaatggctggtacaacgggaagcgaagccgcgaggtgaagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 1718 - DNA, 1552 bp, Bacillus sp. FJAT-20673; identical to SEQ ID NO: 191
  ref <308>: DATABASE ACCESSION NUMBER: NCBI ACCESSION: NZ_KV440963.1
  ref <309>: DATABASE ENTRY DATE: 2019-04-01
  ref <313>: RELEVANT RESIDUES IN SEQ ID NO: (1)..(1552)

SEQ ID NO: 1719 - DNA, 1553 bp, Bacillus sp. FJAT-21351
  ref <308>: DATABASE ACCESSION NUMBER: NCBI ACCESSION: NZ_LITO01000010.1
  ref <309>: DATABASE ENTRY DATE: 2019-04-01
  ref <313>: RELEVANT RESIDUES IN SEQ ID NO: (1)..(1553)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttctaa

SEQ ID NO: 1720 - DNA, 1552 bp, Bacillus sp. FJAT-21352; identical to SEQ ID NO: 191
  ref <308>: DATABASE ACCESSION NUMBER: NCBI ACCESSION: NZ_LIUS01000003.1
  ref <309>: DATABASE ENTRY DATE: 2019-04-01
  ref <313>: RELEVANT RESIDUES IN SEQ ID NO: (1)..(1552)

SEQ ID NO: 1721 - DNA, 1151 bp, Bacillus sp. FJAT-21945
  ref <308>: DATABASE ACCESSION NUMBER: NCBI ACCESSION: NZ_LITN01000007.1
  ref <309>: DATABASE ENTRY DATE: 2019-04-01
  ref <313>: RELEVANT RESIDUES IN SEQ ID NO: (1)..(1151)
gccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccccggctcaaccggggagggtcattggaaactgggagacttgagtgcagaagaggaaagtggaattccaagtgtagcggtgaaatgcgtagagatttggaggaacaccagtggcgaaggcgactttctggtctgtaactgacactgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttctaa

SEQ ID NO: 1722 - DNA, 1550 bp, Bacillus sp. FJAT-21955; identical to SEQ ID NO: 321
  ref <308>: DATABASE ACCESSION NUMBER: NCBI ACCESSION: NZ_LJJA01000015.1
  ref <309>: DATABASE ENTRY DATE: 2019-04-01
  ref <313>: RELEVANT RESIDUES IN SEQ ID NO: (1)..(1550)

SEQ ID NO: 1723 - DNA, 1552 bp, Bacillus sp. FJAT-22058; identical to SEQ ID NO: 191
  ref <308>: DATABASE ACCESSION NUMBER: NCBI ACCESSION: NZ_LIUR01000005.1
  ref <309>: DATABASE ENTRY DATE: 2019-04-01
  ref <313>: RELEVANT RESIDUES IN SEQ ID NO: (1)..(1552)

SEQ ID NO: 1724 - DNA, 1559 bp, Bacillus sp. FJAT-22090
  ref <308>: DATABASE ACCESSION NUMBER: NCBI ACCESSION: NZ_CP012601.1
  ref <309>: DATABASE ENTRY DATE: 2019-04-01
  ref <313>: RELEVANT RESIDUES IN SEQ ID NO: (1)..(1559)
ctattatggagagtttgatcctggctcaggacgaacgctggcggcgtgcctaatacatgcaagtcgagcggatgatgaagaagcttgcttcttctgatttagcggcggacgggtgagtaacacgtgggcaacctgccctgtagattgggataactccgggaaaccggggctaataccgaataatccattccttctcatggagggatgttaaaagacggtttcggctgtcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtgagggaagaacaagtacgagagtaactgctcgtaccttgacggtacctcattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgtcctagagataggattttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggacggtacagagggtcgcaaccccgcgagggtgagctaatcccataaaaccgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtggggtaacccttttgggagccagccgccgaaggtgggacagatgattggggtgaagtcgtaacaaggtagccgtatcggaaggtgcggctggatcacctcctttcta

SEQ ID NO: 1725 - DNA, 1337 bp, Bacillus sp. FJAT-25496
  ref <308>: DATABASE ACCESSION NUMBER: NCBI ACCESSION: NZ_LMBY01000057.1
  ref <309>: DATABASE ENTRY DATE: 2019-04-01
  ref <313>: RELEVANT RESIDUES IN SEQ ID NO: (1)..(1337)
ggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccacgtgtagcggtgaaatgcgtagagatgtggaggaacaccagtggcgaaggcgactttctggtctgtaactgacactgaggcgcgaaagcgtggggagcgaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgccaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 1726 - DNA, 1075 bp, Bacillus sp. FJAT-25509
  ref <308>: DATABASE ACCESSION NUMBER: NCBI ACCESSION: NZ_LJIZ01000029.1
  ref <309>: DATABASE ENTRY DATE: 2019-04-01
  ref <313>: RELEVANT RESIDUES IN SEQ ID NO: (1)..(1075)
accttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgctgtaaacgatgagtgctaagtgttagagggtttccgccctttagtgctgaagttaacgcattaagcactccgcctggggagtacggtcgcaagactgaaactcaaaggaattgacgggggcccgcacaagtggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatagtacaaagggttgcaagaccgcgaggtggagctaatcccataaaactattctcagttcggattgtaggctgcaactcgcctacatgaagccggaatcactagtaatcgcggatcagcatgccgcggtgaatacgttcccgggccttgtacacaccgcccgtcacaccacgagagtttgtaacacccgaagtcggtggggtaaccttttaggggccagccgcctaaggtgggacagatgattggggtgaagtcgtaacaaggtagccgtatcggaaggtgcggctggatcacctcctttctatgga

SEQ ID NO: 1727 - DNA, 1494 bp, Bacillus sp. FJAT-26390
  misc_feature (947)..(947): n is a, c, g, or t
  ref <308>: DATABASE ACCESSION NUMBER: NCBI ACCESSION: NZ_MAQX01000009.1
  ref <309>: DATABASE ENTRY DATE: 2019-04-01
  ref <313>: RELEVANT RESIDUES IN SEQ ID NO: (1)..(1494)
tttggagagtttgatcctggctcaggacgaacgctggcggcgtgcctaatacatgcaagtcgagcggattaagcgtttcttcggaaacgcctagttagcggcggacgggtgagtaacacgtgggtaacctgcctgtaagactgggataacattcggaaacgaatgctaataccggatacgcgatacggtcgcatgaccgaatcgggaaagatggagcaatctatcacttacggatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaatgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggccttgtaagtctgttgtttaaacttggggctcaaccccaagtcgcaatggaaactgcaaagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcaatacccttggtgccgaagttaacacattaagcattccgcctggggagtacggtcgcaagactgaaactcaaaggaattgacggggacccgcacaagcnaagcattagagatagtgcccctcttcggagcattggagacaggtggtgcatggttgtcgtcagctcgtgtcgtgagatgttgggttaagtcccgcaacgagcgcaacccttgatcttagttgccagcactttgggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaacccgcaagggagctagccgtcgaaggtggggtagatgattggggtgaagtcgtaacaaggtagccgtatcggaaggtgcggctggatcacctcctttctaagga

SEQ ID NO: 1728 - DNA, 1138 bp, Bacillus sp. FJAT-27225
  ref <308>: DATABASE ACCESSION NUMBER: NCBI ACCESSION: NZ_MAYU01000023.1
  ref <309>: DATABASE ENTRY DATE: 2019-04-01
  ref <313>: RELEVANT RESIDUES IN SEQ ID NO: (1)..(1138)
tttcttggagagtttgatcctggctcaggacgaacgctggcggcgtgcctaatacatgcaagtcgagcgaatctttgggagcttgctcctaaagattagcggcggacgggtgagtaacacgtgggcaacctgcctgtaagactgggataacttcgggaaaccggagctaataccggataattcttttctactcatgtaggaaagctgaaagacggtttcggctgtcacttatagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacacctctggagacagagcgttccccttcgggggacagagtgacaggtggtgcatggttgtcgtcagctcgtgtcgtgagatgttgggttaagtcccgcaacgagcgcaacccttgtccttagttgc

SEQ ID NO: 1729 - DNA, 1559 bp, Bacillus sp. FJAT-27231
  ref <308>: DATABASE ACCESSION NUMBER: NCBI ACCESSION: NZ_LFZU01000001.1
  ref <309>: DATABASE ENTRY DATE: 2019-04-01
  ref <313>: RELEVANT RESIDUES IN SEQ ID NO: (1)..(1559)
ctttttggagagtttgatcctggctcaggacgaacgctggcggcgtgcctaatacatgcaagtcgagcggacttgacggagcttgctctgttcaagttagcggcggacgggtgagtaacacgtgggtaacctgcctgtaagactgggataactccgggaaaccggggctaataccggatattctttcttctccgcatggagaaggatggaaaggcggcttcggctgtcacttacagatggacccgcggcgcattagctagttggtggggtaatggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgttagggaagaacaagtacgggagtaactgtccgtaccttgacggtacctaaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccggtctggagacagatctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcaaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgcctaaggtggggcagatgattggggtgaagtcgtaacaaggtagccgtatcggaaggtgcggctggatcacctcctttctaa

SEQ ID NO: 1730 - DNA, 1541 bp, Bacillus sp. FJAT-27238
  ref <308>: DATABASE ACCESSION NUMBER: NCBI ACCESSION: NZ_LGJF01000001.1
  ref <309>: DATABASE ENTRY DATE: 2019-04-01
  ref <313>: RELEVANT RESIDUES IN SEQ ID NO: (1)..(1541)
ctttattggagagtttgatcctggctcaggacgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggatcgcatgatccgaaaagaaaagatggcttcggctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 1731 - DNA, 1557 bp, Bacillus sp. FJAT-27245
  ref <308>: DATABASE ACCESSION NUMBER: NCBI ACCESSION: NZ_LIGI01000005.1
  ref <309>: DATABASE ENTRY DATE: 2019-04-01
  ref <313>: RELEVANT RESIDUES IN SEQ ID NO: (1)..(1557)
ctttttggagagtttgatcctggctcaggacgaacgctggcggcgtgcctaatacatgcaagtcgagcggargtttcaaaagcttgcttttggaacttcagcggcggacgggkgagtaacacgtgggcaacctgcctgtaagactgggataacttcgggaaaccggagctaataccggataaycctttccttcacatggaggraagctraaagacggtttcggctgtcacttacagatgggcccgcggcgcattagctagttggtggggtaacggcccaccaaggcgacgatgcgtagccgacctgagagggtgatcggccacactgggactgagasacggcccagactcctacgggaggcagcagtagggaatcttccgcaatggacgaaagtctgacggagcaacgccgcgtgagcgaagaaggccttcgggtcgtaaagctctgttgtcagggaagaacgagtaccggagtaactgccggtaccttgacggtacctgaccagaaagccacggctaactacgtgccagcagccgcggtaatacgtaggtggcaagcgttgtccggaattattgggcgtaaagcgcgcgcaggcggcctcttaaggctgatgtgaaagcccacggctcaaccgtggagggtcattggaaactggggggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaractcaaaggaattgacgggggcccgcacaagcggtggagcatgtggtttaattcgaagcaacgcgaagaaccttmccaggtcttgacatcctctgacactcctggagacaggacgttccccttcgggggacagagtgacaggtggtgcatggttgtcgtcagctcgtgtcgtgagatgttgggttaagtcccgcaactagcgcaacccttgatcttagttgccagcattcagttgggcactctaaggtgactgccggtgacaaaccggaggaaggtggggatgacgtcaaatcatcatgccccttatgacctgggctacacaygtgctacaatggatggtacaaagggcagcgaagccgcgaggtgaagccaatcccataaaaccattctcagttcggattgcaggctgcaactcgcctgcatgaagccggaatcgctagtaatcgcggatcagcatgccgcggcgaatacgttcccgggccttgtacacaccgcccgtcacaccacgggagtttgtaacacccgaagtcggtggggtaaccgcaaggagccagccgcctaaggtgggacagatgactggggtgaagtcgtaacaaggtagccgtatcggaaggtgcggctggatcacctcctttctaa

SEQ ID NO: 1732 - DNA, 1566 bp, Bacillus sp. FJAT-27264
  ref <308>: DATABASE ACCESSION NUMBER: NCBI ACCESSION: NZ_MAQW01000006.1
  ref <309>: DATABASE ENTRY DATE: 2019-04-01
  ref <313>: RELEVANT RESIDUES IN SEQ ID NO: (1)..(1566)
tttggagagtttgatcctggctcaggacgaacgctggcggcgtgcctaatacatgcaagtcgagcggacttgatggagtgcttgcactcctgatggttagcggcggacgggtgagtaacacgtaggcaacctgccccacagactgggataactaccggaaacggtagctaataccggataattccttttagctcctgctaagaggatgaaagacggagcaatctgtcactgcgggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggctatttaagtctggtgtttaaaccatgggctcaacctgtggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcattaggtgcccttcggggaaagttgagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggaga

SEQ ID NO: 1733 - DNA, 1556 bp, Bacillus sp. FJAT-27445
  ref <308>: DATABASE ACCESSION NUMBER: NCBI ACCESSION: NZ_LMTI01000013.1
  ref <309>: DATABASE ENTRY DATE: 2019-04-01
  ref <313>: RELEVANT RESIDUES IN SEQ ID NO: (1)..(1556)
ttttttggagagtttgatcctggctcaggacgaacgctggcggcgtgcctaatacatgcaagtcgagcggagttttaaaagcttgcttttaaaactcagcggcggacgggtgagtaacacgtgggcaacctgcctgtaagactgggataacttcgggaaaccggagctaataccggataaccctttccttcacatggaggaaagctgaaagacggcttctcgctgtcacttacagatgggcccgcggcgcattagctagttggtggggtaacggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtgccggagtaactgccggcaccttgacggtacctgaccagaaagccacggctaactacgtgccagcagccgcggtaatacgtaggtggcaagcgttgtccggaattattgggcgtaaagcgcgcgcaggcggcctcttaagtctgatgtgaaagcccacggctcaaccgtggagggtcattggaaactggggggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctggagacaggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgggagtttgtaacacccgaagtcggtggggtaaccgcaaggagccagccgcctaaggtgggacagatgactggggtgaagtcgtaacaaggtagccgtatcggaaggtgcggctggatcacctcctttctaa

SEQ ID NO: 1734 - DNA, 1561 bp, Bacillus sp. FJAT-27916
  ref <308>: DATABASE ACCESSION NUMBER: NCBI ACCESSION: NZ_LFZV01000001.1
  ref <309>: DATABASE ENTRY DATE: 2019-04-01
  ref <313>: RELEVANT RESIDUES IN SEQ ID NO: (1)..(1561)
tcttttggagagtttgatcctggctcaggacgaacgctggcggcgtgcctaatacatgcaagtcgagcgaatcagatgggagcttgctcccggatgattagcggcggacgggtgagtaacacgtgggcaacctgcccgtaagattgggataactccgggaaaccggtgctaataccgaatagtttctgacacctcatggtgtcagagggaaagttggcttttagctaacacttacggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtgccattcgaataggttggcaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcgttccccttcgggggacagagtgacaggtggtgcatggttgtcgtcagctcgtgtcgtgagatgttgggttaagtcccgcaacgagcgcaacccttgtccttagttgccagcattcagttgggcactctagggagactgccggtgacaaaccggaggaaggtggggatgacgtcaaatcatcatgccccttatgacctgggctacacacgtgctacaatgggtggtacaaagggcagcaagaccgcgaggttaagcaaatcccataaaaccactctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 1735 - DNA, 1357 bp, Bacillus sp. FJAT-27986
  ref <308>: DATABASE ACCESSION NUMBER: NCBI ACCESSION: NZ_MAYV01000011.1
  ref <309>: DATABASE ENTRY DATE: 2019-04-01
  ref <313>: RELEVANT RESIDUES IN SEQ ID NO: (1)..(1357)
ggaaggaaagttggcttcggctaacacttagggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtcagggaagaacaagtaccgttcgaatagggcggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctctgataactctggagacagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggtggtacaaagggctgcaaaaccgcgaggtcgagcaaatcccataaaaccactctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 1736 - DNA, 481 bp, Bacillus sp. FJAT-28004
  ref <308>: DATABASE ACCESSION NUMBER: NCBI ACCESSION: NZ_LGHP01000001.1
  ref <309>: DATABASE ENTRY DATE: 2019-04-01
  ref <313>: RELEVANT RESIDUES IN SEQ ID NO: (1)..(481)
tttggagagtttgatcctggctcaggacgaacgctggcggcgtgcctaatacatgcaagtcgagcggagttgatgaggtgcttgcacctctgatacttagcggcggacgggtgagtaacacgtgggtaacctgcctataagactkggataacattcggaaacgaatgctaataccggatacgcgatwtggtcgcatgatcgaatcgggaaagatggagmaatctatcacttatagatggacccgcggcgcattagctagttggtgaggtaacggctcaccaaggcgacgatgcgtagccgacctgagagggtgatcggccacactgggactgagacacggcccagactcctacgggaggcagcagtakggaatcttccgcaatggacgaaagtctgacggagcaacgccgcgtgagtgatgaaggttttcggatcgtaaagctctgttgccagggaagaatgcttgggagagtaactgctc

SEQ ID NO: 1737 - DNA, 1554 bp, Bacillus sp. FJAT-28573
  ref <308>: DATABASE ACCESSION NUMBER: NCBI ACCESSION: NZ_LMXG01000007.1
  ref <309>: DATABASE ENTRY DATE: 2019-04-01
  ref <313>: RELEVANT RESIDUES IN SEQ ID NO: (1)..(1554)
tttttggagagtttgatcctggctcaggacgaacgctggcggcgtgcctaatacatgcaagtcgagcgaatgatagggagcttgctcccttgatttagcggcggacgggtgagtaacacgtgggcaacctacctgtaagactgggataacttcgggaaaccggagctaataccggataatttcttttctcgcatgagaagagatggaaagacggtttcggctgtcacttacagatgggcccgcggcgcattagctagttggtgaggtaatggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttttgccctccctagagatagggacttcccttcggggacaaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagagctgcaaacccgcgagggtaagcgaatctcataaagccattctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtgaggtaaccgcaaggagccagccgcctaaggtgggacagatgattggggtgaagtcgtaacaaggtagccgtatcggaaggtgcggctggatcacctcctttctaa

SEQ ID NO: 1738 - DNA, 1322 bp, Bacillus sp. FJAT-29814
  ref <308>: DATABASE ACCESSION NUMBER: NCBI ACCESSION: NZ_LMTJ01000022.1
  ref <309>: DATABASE ENTRY DATE: 2019-04-01
  ref <313>: RELEVANT RESIDUES IN SEQ ID NO: (1)..(1322)
gatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgaagaaggccttcgggtcgtaaagctctgttgtcagggaagaacaagtatcggagtaactgccggtaccttgacggtacctgaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggaatttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcgaggttgagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttctaa

SEQ ID NO: 1739 - DNA, 1558 bp, Bacillus sp. FJAT-44921
  ref <308>: DATABASE ACCESSION NUMBER: NCBI ACCESSION: NZ_KV917381.1
  ref <309>: DATABASE ENTRY DATE: 2019-04-01
  ref <313>: RELEVANT RESIDUES IN SEQ ID NO: (1)..(1558)
tttatggagagtttgatcctggctcaggacgaacgctggcggcgtgcctaatacatgcaagtcgagcggactgtttaaaagcttgcttttaaacagttagcggcggacgggtgagtaacacgtgggcaacctgccctgtagactgggataacaccgagaaatcggtgctaataccggataactttgaggtcacatgacctcaaattaaaagatggctccggctatcactacaggatgggcccgcggcgcattagctagttggtagggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtgccgttcgaataggtcggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactgggagacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacagtaagcactccgcctggggagtacggccgcaaggctgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcgaggttgagcgaatcccataaaaccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtgaggtaactgctagtcagagccagccgcctaaggtgggacagatgattggggtgaagtcgtaacaaggtagccgtatcggaaggtgcggctggatcacctcctttcta

SEQ ID NO: 1740 - DNA, 1270 bp, Bacillus sp. FMQ74
  ref <308>: DATABASE ACCESSION NUMBER: NCBI ACCESSION: NZ_MOEO01000030.1
  ref <309>: DATABASE ENTRY DATE: 2019-04-01
  ref <313>: RELEVANT RESIDUES IN SEQ ID NO: (1)..(1270)
acgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1741 - DNA, 1422 bp, Bacillus sp. G1 2015b
  ref <308>: DATABASE ACCESSION NUMBER: NCBI ACCESSION: NZ_LKIC01000021.1
  ref <309>: DATABASE ENTRY DATE: 2019-04-01
  ref <313>: RELEVANT RESIDUES IN SEQ ID NO: (1)..(1422)
cctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1742 - DNA, 1556 bp, Bacillus sp. G3 2015; identical to SEQ ID NO: 120
  ref <308>: DATABASE ACCESSION NUMBER: NCBI ACCESSION: NZ_LKID01000070.1
  ref <309>: DATABASE ENTRY DATE: 2019-04-01
  ref <313>: RELEVANT RESIDUES IN SEQ ID NO: (1)..(1556)

SEQ ID NO: 1743 - DNA, 412 bp, Bacillus sp. GZB
  ref <308>: DATABASE ACCESSION NUMBER: NCBI ACCESSION: NZ_MTQG01000016.1
  ref <309>: DATABASE ENTRY DATE: 2019-04-01
  ref <313>: RELEVANT RESIDUES IN SEQ ID NO: (1)..(412)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgt

(The sequence listing continues in the following parts.)

What is claimed is:

1. A modified plant seed comprising at least 10,000 CFU of bacteria artificially incorporated between a seed coat and an embryo of said modified plant seed, wherein said bacteria are incorporated between the seed coat and an aleurone cell layer.

2. The modified plant seed of claim 1, wherein said bacteria comprise endospore forming bacteria or endospores thereof.

3. The modified plant seed of claim 1, wherein said modified plant seed further comprises a microbial exudate.

4. The modified plant seed of claim 3, wherein said microbial exudate is derived from said bacteria.

5. The modified plant seed of claim 3, wherein said microbial exudate is not derived from said bacteria.

6. The modified plant seed of claim 1, wherein said bacteria comprise bacteria from the phyla Firmicutes, Proteobacteria, Actinobacteria, or a combination thereof.

7. The modified plant seed of claim 6, wherein said bacteria comprise bacteria from *Acetonema* sp., *Actinomyces* sp., *Alkalibacillus* sp., *Ammoniphilus* sp., *Amphibacillus* sp., *Anaerobacter* sp., *Anaerospora* sp., *Aneurinibacillus* sp., *Anoxybacillus* sp., *Bacillus* sp., *Brevibacillus* sp., *Caldanaerobacter* sp., *Caloramator* sp., *Caminicella* sp., *Cerasibacillus* sp., *Clostridium* sp., *Clostridiisalibacter* sp., *Cohnella* sp., *Coxiella* sp. *Dendrosporobacter* sp., *Desulfotomaculum* sp., *Desulfosporomusa* sp., *Desulfosporosinus* sp., *Desulfovirgula* sp., *Desulfunispora* sp., *Desulfunispora* sp., *Filifactor* sp., *Filobacillus* sp., *Gelria* sp., *Geobacillus* sp., *Geosporobacter* sp.,*Gracilibacillus* sp., *Halobacillus* sp., *Halonatronum* sp., *Heliobacterium* sp., *Heliophilum* sp., *Laceyella* sp., *Lentibacillus* sp., *Lysinibacillus* sp., *Mahela* sp., *Metabacterium* sp., *Moorella* sp., *Natroniella* sp., *Oceanobacillus* sp., *Orenia* sp., *Ornithinibacillus* sp., *Oxalophagus* sp., *Oxobacter* sp., *Paenibacillus* sp., *Paraliobacillus* sp., *Pelospora* sp., *Pelotomaculum* sp., *Piscibacillus* sp., *Planifilum* sp., *Pontibacillus* sp., *Propionispora* sp., *Salinibacillus* sp., *Salsuginibacillus* sp., *Seinonella* sp., *Shimazuella* sp., *Sporacetigenium* sp., *Sporoanaerobacter* sp., *Sporobacter* sp., *Sporobacterium* sp., *Sporohalobacter* sp., *Sporolactobacillus* sp., *Sporomusa* sp., *Sporosarcina* sp., *Sporotalea* sp., *Sporotomaculum* sp., *Syntrophomonas* sp., *Syntrophospora* sp., *Tenuibacillus* sp., *Tepidibacter* sp., *Terribacillus* sp., *Thalassobacillus* sp., *Thermoacetogenium* sp., *Thermoactinomyces* sp., *Thermoalkalibacillus* sp., *Thermoanaerobacter* sp., *Thermoanaeromonas* sp., *Thermobacillus* sp., *Thermoflavimicrobium* sp., *Thermovenabulum* sp., *Tuberibacillus* sp., *Virgibacillus* sp., *Vulcanobacillus* sp., or a combination thereof.

8. The modified plant seed of claim 7, wherein said bacteria comprise bacteria from *Bacillus* sp.

9. The modified plant seed of claim 7, wherein said bacteria comprise bacteria from *Paenibacillus* sp.

10. The modified plant seed of claim 6, wherein said bacteria comprise bacteria from, *Actinomyces* sp., *Acetobacter* sp., *Herbaspirillum* sp., *Pseudomonas* sp., *Paraburkholderia* sp., *Serratia* sp., *Pantoea* sp., *Ensifer* sp., *Enterobacter* sp., or any combination thereof.

11. The modified plant seed of claim 10, wherein said bacteria comprise bacteria from *Ensifer* sp.

12. The modified plant seed of claim 6, wherein said bacteria comprise bacteria from *Coxiella* sp.

13. The modified plant seed of claim 1, wherein said modified plant seed is a maize seed, wheat seed, rice seed, sorghum seed, barley seed, rye seed, sugar cane seed, millet seed, oat seed, soybean seed, cotton seed, alfalfa seed, bean seed, *quinoa* seed, lentil seed, peanut seed, lettuce seed, tomato seed, pea seed, or cabbage seed.

14. The modified plant seed of claim 1, wherein said seed coat is the seed pericarp.

15. The modified plant seed of claim 1, wherein said modified plant seed is shelf stable for at least one month.

* * * * *